United States Patent
Yu et al.

(10) Patent No.: US 9,068,984 B2
(45) Date of Patent: Jun. 30, 2015

(54) COMPOSITIONS AND METHODS FOR TREATMENT OF NEUROPATHIC PAIN

(75) Inventors: Lei Yu, Belle Mead, NJ (US); Ning Guo, Shanghai (CN); Yu-Qui Zhang, Shanghai (CN); Zhi-Qi Zhao, Shanghai (CN); Naihe Jing, Shanghai (CN)

(73) Assignee: RUTGERS, THE STATE UNIVERSITY OF NEW JERSEY, New Brunswick, NJ (US)

( * ) Notice: Subject to any disclaimer, the term of this patent is extended or adjusted under 35 U.S.C. 154(b) by 286 days.

(21) Appl. No.: 13/393,399

(22) PCT Filed: Sep. 2, 2010

(86) PCT No.: PCT/US2010/047657
§ 371 (c)(1),
(2), (4) Date: Jun. 4, 2012

(87) PCT Pub. No.: WO2011/028890
PCT Pub. Date: Mar. 10, 2011

(65) Prior Publication Data
US 2012/0245216 A1   Sep. 27, 2012

Related U.S. Application Data

(60) Provisional application No. 61/239,065, filed on Sep. 2, 2009.

(51) Int. Cl.
*C12N 15/113* (2010.01)
*G01N 33/566* (2006.01)
*C07K 14/47* (2006.01)

(52) U.S. Cl.
CPC ............... *G01N 33/566* (2013.01); *C07K 14/47* (2013.01); *C12N 15/113* (2013.01); *C12N 2310/11* (2013.01); *G01N 2500/04* (2013.01); *G01N 2800/2842* (2013.01)

(58) Field of Classification Search
None
See application file for complete search history.

(56) References Cited

U.S. PATENT DOCUMENTS

2008/0268063 A1   10/2008   Jon et al.

FOREIGN PATENT DOCUMENTS

WO   2005014849 A2   2/2005

OTHER PUBLICATIONS

Foulkes et al. PLoS Genet 2008, vol. 4, No. 7: e1000086. doi:10.1371/journal.pgen.1000086.*
Peng et al., SIP30 Is Regulated by ERK in Peripheral Nerve Injury-induced Neuropathic Pain. Journal of Biological Chemistry 284(44): 30138-30147. (2009).
Zhang et al., "Role of SIP30 in the development and maintenance of peripheral nerve injury-induced neuropathic pain," Pain (Jul. 13, 2009): 146:130-140; abstract; p. 131, col. 1, para 4.

* cited by examiner

*Primary Examiner* — Tracy Vivlemore
(74) *Attorney, Agent, or Firm* — Fox Rothschild LLP

(57) ABSTRACT

The present invention relates to compounds, compositions, methods, systems and kits for treating neuropathic pain regulated by SIP30. The present invention provides SIP30 antagonists for the treatment of neuropathic pain.

21 Claims, 12 Drawing Sheets

```
Hsa    MEAAETEAEAAAL               EVLAEVAGILEPVGLQEEAELPAKILVEFVVDSQK
Ptr    -------------               -----------------------------------
Mml    -------------               -----------------------------------
Cfa    -AE--VG-R-Q--               -A--ALGD------R---V----Q--A---M-R-
Ssc    ------K-----R               -A--K--D----T---------Q--A---M-R-
Bta    -G---S-V-T--R               ----K--D-Q----F-------Q--A---M-R-
Mmu    -AD--KN-V-EKN      NAVA     TK-----A-A------------ME--MRN-R-
Rno    -AD--KN-V-EKNAVAEENAVAEENAVADKNATK-----A-SV-----P---------ME--MRN-R-

Hsa    DKLLCSQLQVADFLQNILAQED TAKGLDPLASEDTSRQKAIAAKEQWKELKATYREHVEAIKIGLTKA
Ptr    --------------------- --------------------------------------------
Mml    ------V-------------- --------------------------------------------
Cfa    -------V-----F----G   IVQ-------------L-V-------Q-------TGA--Q-
Ssc    -------V-----F-I---   --Q--------KR--E----------Q------TSA--Q-
Bta    -------V-----F-V--G   --QDQN--------LE----------Q-----V-TNS--E-
Mmu    ---------VN---TF----- -EQSP-A------A-----TET-----DM----MD--DV--CA-SE-
Rno    ---------VN---TF-----N-DQNP-A------A-----TET-----------MD--DV--CA-SE-

Hsa    TQMEEAQRKRTQLREAFEQLQAKKQMAMEKRRAVQNQWQLQQEKHLQHLAEVSAEVRERKTGTQQELDR
Ptr    ---------------Q---------------------------------------------A-EG
Mml    ---------------Q-------V-------A---------------K----------------EG
Cfa    AKT----S-V--Q--L--------V---RA-TA-K-------R------A-----Q-QR-A----E-
Ssc    PK-----K-QA--Q-TL-------V-V--L-IA-K-----------TK-----K--QM-----FE-
Bta    PKV----I-QA--Q--LK-------L-IA-K----E------N---A-S-----Q--A----Q-
Mmu    P-VK--H--Y-E-QK-----E---RVLE--LQLA-K--V--- -R--N-TKI----KR-RKRALEK--G
Rno    P-VK--H--Y-E-QK-----E---RVLE--LQLA-K--V---  -R--N-TKI----KR-RKRALEK--G

Hsa    PQKLGNLKQQAEQERDKLQRYQTFLQLLYTLQGKLLFPEAEAEAEN       LPDDKPQQPTRPQEQSTG
Ptr    ---------------------------------------------       ------------------
Mml    ----------Q----------------------------------       -----L------------
Cfa    R-E--A-Q---G--R---H----R--HI---EP-L-G--T-R          -QELGIPEAK-R--N--
Ssc    Y-E--A----R--Q-----H--------------S-----QIPQELN--K---L-L-Q----NPQ
Bta    Y-E--T---G--K-----H-----------Q--N-----I    PQELD--K--L--V-Q----N-Q
Mmu    H-E-ET-----G--QE----N-SY----CS--N--VIS-GK--D        K-VKGRALTAKSK-P
Rno    H-E-ET-----G--QE----N-SY----CS--N--VIS-SK-DD        K-VKGPAL  PPK-P

Hsa    TMGRDPGVSFKAVGLQPAGDVNLP  (SEQ ID NO 135)
Ptr    --------------------A--- (SEQ ID NO 140)
Mml    -----A--------S------A--- (SEQ ID NO 153)
Cfa    AV-K-RS-PSQ-D-----RGTSSRWFPEGQQHGKGT (SEQ ID NO 159)
Ssc    I----GS-S-VDSP--I--AS--WLPGAQQHGEGS (SEQ ID NO 160)
Bta    ----    E-DNP--V--AG--WLPGRQQHKEES (SEQ ID NO 150)
Mmu       (SEQ ID NO 146)
Rno       (SEQ ID NO 143)
```

FIG. 2

COMPOSITIONS AND METHODS FOR TREATMENT OF NEUROPATHIC PAIN

CROSS-REFERENCE TO RELATED APPLICATIONS

This application is the U.S. National Phase Application of International Application No. PCT/US10/047657, which claims priority under 35 U.S.C. §119 (e) to U.S. Provisional Patent Application Ser. No. 61/239,065 filed on Sep. 2, 2009, both of which are hereby incorporated by reference in their entireties.

STATEMENT REGARDING FEDERALLY FUNDED RESEARCH

The Research leading to the present invention was supported in part, by NIH Grant No. R01 DA013471. Accordingly, the U.S. Government has certain rights in this invention.

FIELD OF THE INVENTION

The present invention relates to the treatment of neuropathic pain in a mammalian using SIP30 antagonists.

BACKGROUND OF THE INVENTION

Neuropathic pain is a complex, chronic pain state that is generally accompanied by tissue injury. With neuropathic pain, the nerve fibers themselves might be damaged, dysfunctional, or injured. These damaged nerve fibers send incorrect signals to other pain centers. The clinical causes of neuropathic pain are widespread and include both trauma and disease. For example, traumatic nerve compression or crush and traumatic injury to the brain or spinal cord are common causes of neuropathic pain. Furthermore, most traumatic nerve injuries also cause the formation of neuromas, in which pain occurs as a result of aberrant nerve regeneration. In addition, cancer-related neuropathic pain is caused when tumor growth painfully compresses adjacent nerves, brain or spinal cord. Neuropathic pain is associated with diseases such as diabetes or alcoholism.

Unfortunately, the available drug therapies for neuropathic pain often do not provide the patients in need of such treatment the adequate pain relief. In addition, current therapies have serious side-effects including, for example, cognitive changes, sedation, nausea and, in the case of narcotic drugs, addiction. Many patients suffering from neuropathic pain are elderly or have other medical conditions that particularly limit their tolerance of the side-effects associated with available drug therapy. A number of anti-inflammatory, anxiolytic, narcotic and even anti-convulsants are currently used by the practitioners to treat neuropathic pain, but with limited success.

The inadequacy of current therapy in relieving neuropathic pain calls for new compositions and methodologies of addressing the physical and social needs of the patient suffering from such condition. Methods of alleviating neuropathic pain would improve the quality of life for many people suffering from pain due to trauma or disease.

SUMMARY OF THE INVENTION

The present invention fills the foregoing need by providing compounds, compositions, methods and systems for treating neuropathic pain regulated by SIP30. Applicants have surprisingly found that SIP30 antagonists are effective in treating neuropathic pain. The present invention also provides a screening method comprising: providing a sample containing at least a portion of an SIP30 polypeptide; adding a test compound to at least a first portion of the sample; comparing at least one parameter from at least the first portion of the sample with the at least one parameter from at least a second portion of the sample, wherein at least the second portion of the sample does not include the test compound. Applicants invention also process of determining a substance for its ability to interact with SIP30-like molecule protein comprising: a) providing a SIP30-like molecule polypeptide comprising the contiguous amino acid sequence of any from the group of SEQ ID B1 through SEQ ID B130; and b) testing the ability of said substance to interact with a SIP30-like molecule.

BRIEF DESCRIPTION OF THE DRAWINGS

FIG. 2. illustrates amino acid sequence alignment of mammalian SIP30 orthologues shows high degree of sequence homology, implicating similar function. Amino acid sequences of all mammalian SIP30 available in public domain are aligned. Gaps in alignment are shown as blank space. Amino acid residue identity with that of the corresponding human SIP30 sequence is indicated by a dash (-). Underline: putative coiled-coil domain. The common name, the Latin name, and the 3 letter abbreviation of each species are as following: Human—*Homo sapiens*—Hsa, Chimpanzee—*Pan troglodytes*—Ptr, Rhesus monkey—*Macaca Mulatta*—Mml, Dog—*Canis lupus familiaris*—Cfa, Pig—*Sus scrofa*—Ssc, Cow—*Bos taurus*—Bta, Mouse—*Mus musculus*—Mmu, and Rat—*Rattus Norvegicus*—Rno.

DETAILED DESCRIPTION OF THE INVENTION

Figure 1A:
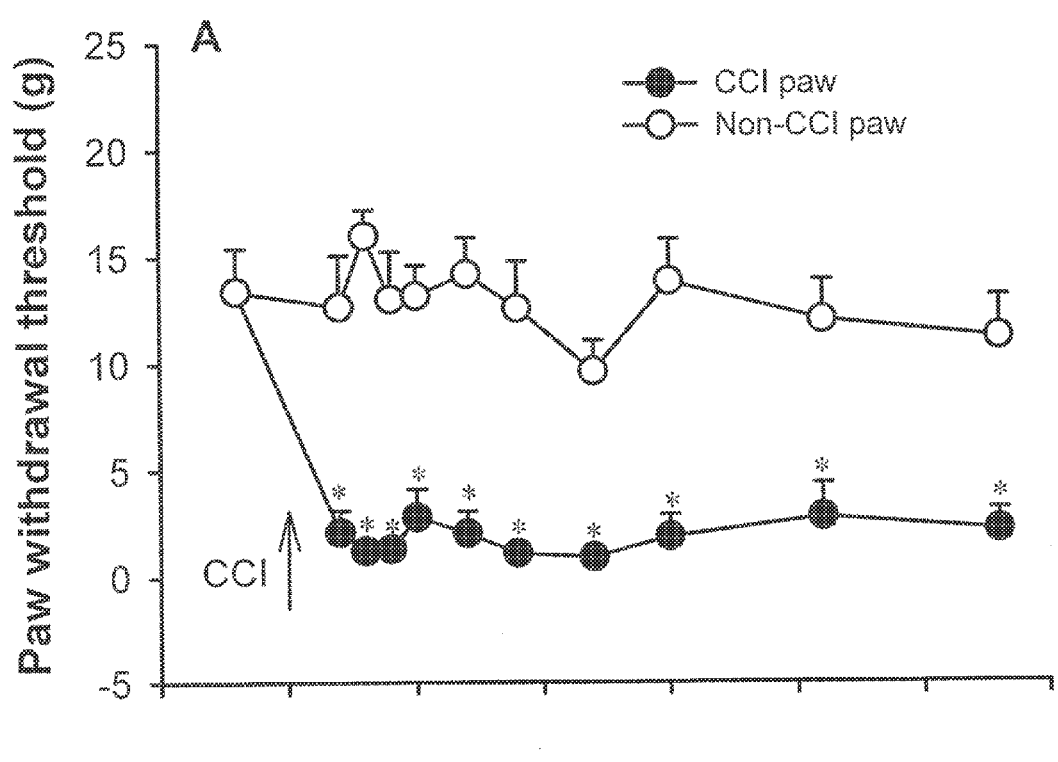
FIG. 1. illustrates rapid onset of thermal hyperalgesia and mechanical allodynia in rats receiving CCI surgery. Time courses for the development of mechanical allodynia (A) and thermal hyperalgesia (B) following chronic constriction injury of sciatic nerve were shown. $p<0.05$ vs. non-CCI injury paw.

To aid in the understanding of the invention, the following non-limiting definitions are provided:

The term "allodynia" refers to a painful response to a usually non-painful stimulus and can be either static or mechanical. The pathophysiology of allodynia is thought to differs from referred pain, but can occur in areas other than the one stimulated.

The term "gene" refers to a DNA sequence that comprises control and coding sequences necessary for the production of a polypeptide or its precursor. The polypeptide can be encoded by a full length coding sequence (either genomic DNA or cDNA) or by any portion of the coding sequence so long as the desired activity is retained. In some aspects, the term "gene" also refers to an mRNA sequence or a portion thereof that directly codes for a polypeptide or its precursor.

The term "transfection" refers to the uptake of foreign DNA by a cell. A cell has been "transfected" when exogenous (i.e., foreign) DNA has been introduced inside the cell membrane. Transfection can be either transient (i.e., the introduced DNA remains extrachromosomal and is diluted out during cell division) or stable (i.e., the introduced DNA integrates into the cell genome or is maintained as a stable episomal element).

The term "Co-transfection" refers to the simultaneous or sequential transfection of two or more vectors into a given cell.

The term "promoter element" or "promoter" refers to a DNA regulatory region capable of binding an RNA polymerase in a cell (e.g., directly or through other promoter-bound proteins or substances) and initiating transcription of a coding sequence. A promoter sequence is, in general, bounded at its 3' terminus by the transcription initiation site and extends upstream (5' direction) to include the minimum number of bases or elements necessary to initiate transcription at any level. Within the promoter sequence may be found a transcription initiation site (conveniently defined, for example, by mapping with nuclease Si), as well as protein binding domains (consensus sequences) responsible for the binding of RNA polymerase. The promoter may be operably associated with other expression control sequences, including enhancer and repressor sequences.

The term "in operable combination", "in operable order" or "operably linked" refers to the linkage of nucleic acid sequences in such a manner that a nucleic acid molecule capable of directing the transcription of a given gene and/or the synthesis of a desired protein molecule is produced. The term also refers to the linkage of amino acid sequences in such a manner so that a functional protein is produced.

The term "vector" refers to a nucleic acid assembly capable of transferring gene sequences to target cells (e.g., viral vectors, non-viral vectors, particulate carriers, and liposomes). The term "expression vector" refers to a nucleic acid assembly containing a promoter which is capable of directing the expression of a sequence or gene of interest in a cell. Vectors typically contain nucleic acid sequences encoding selectable markers for selection of cells that have been transfected by the vector. Generally, "vector construct," "expression vector," and "gene transfer vector," refer to any nucleic acid construct capable of directing the expression of a gene of interest and which can transfer gene sequences to target cells. Thus, the term includes cloning and expression vehicles, as well as viral vectors.

The term "antibody" refers to a whole antibody, both polyclonal and monoclonal, or a fragment thereof, for example a $F(ab)_2$, Fab, FV, VH or VK fragment, a single chain antibody, a multimeric monospecific antibody or fragment thereof, or a bi- or multi-specific antibody or fragment thereof. The term also includes humanized and chimeric antibodies.

The term "SIP30" refers to a nucleic acid sequence that encodes a 266 amino acid protein SNAP25 interacting protein of 30 kDa. SIP30 is expressed abundantly in nerve tissues and slightly in testis and kidney. The term "SIP30-related" refers to any of a nucleic acid sequence listed in SEQ ID A1 through SEQ ID A130.

The term "SIP30 antagonist" refers to any substance, compound and compositions, synthetic or natural, including but not limited to antisense nucleic acid sequences, siRNA, antibodies, small molecular entities, alone or in combination that can prevent, inhibit, reduce or neutralize the expression and activity of SIP30, directly or indirectly modulating the activity of neuropathic pain inducing intermediaries "NPII."

The term "SNAREs" refers to one type of NPII, which is a soluble N-ethylmaleimide-sensitive factor attachment protein receptors, including but not limited to synaptosome-associated proteins of 25 kDa (SNAP25), syntaxins, and vesicle-associated membrane proteins (VAMP), which are essential for regulated exocytosis of synaptic vesicles in neurotransmission.

The term "treating" or "treatment" of a disease refers to executing a protocol, which may include administering one or more drugs to a patient (human or otherwise), in an effort to alleviate signs or symptoms of the disease. Alleviation can occur prior to signs or symptoms of the disease appearing, as well as after their appearance. Thus, "treating" or "treatment" includes "preventing" or "prevention" of disease. In addition, "treating" or "treatment" does not require complete alleviation of signs or symptoms, does not require a cure, and specifically includes protocols which have only a marginal effect on the patient.

The term "patient" refers to a biological system to which a treatment can be administered. A biological system can include, for example, an individual cell, a set of cells (e.g., a cell culture), an organ, a tissue, or a multi-cellular organism. A patient can refer to a human patient or a non-human patient.

The term "hyperalgeisa" refers to an increased sensitivity to pain, which may be caused by damage to nociceptors or peripheral nerves.

The present invention is directed to compounds, compositions, methods and systems for treating neuropathic pain regulated by SIP30. Applicants have surprisingly found that SIP30 antagonists are effective in treating neuropathic pain. Applicants have found that that SPI30 antagonists including but not limited to nucleotides, small interfering RNA (siRNA) molecules, natural or synthetic compounds that correspond to at least a portion of SPI30 nucleic acid sequence are effective in inhibiting the expression of SIP30, directly, or indirectly through modulating the activity of NPII and thereby providing a means for treating pain caused thereby.

In another aspect of the present invention, small molecules capable of altering the configuration of SIP30 dependent intermediary proteins, thereby antagonizing the expression of SIP30. In yet another embodiment, the antagonistic effect may be accomplished by siRNAs that have a specific substrate binding site which is complementary to one or more of the target nucleic acid regions or (i.e., able to base-pair with) a portion of a target RNA. Preferably, such complementarity is 100%, but can be less if desired, such as 91%, 92%, 93%, 94%, 95%, 96%, 97%, 98%, or 99%.

Accordingly, one aspect of the present invention provides the use of DNA fragments, peptides, compounds, compositions thereof in the effected area to antagonize the expression and/or activity of SIP30. Another aspect of the present invention is directed to synthetic or natural compounds that antagonize the activity of NPII. Yet another aspect of the invention is directed to implant depots to deliver a suitable molecule to the area of interest triggering neuropathic pain.

At least one aspect of the invention is directed to the nucleic acid molecules corresponding to at least a portion of a neuropathic pain inducing nucleic acid sequences capable of inhibiting expression of NPII or any related pain inducing cytokines in a cell.

In another aspect of the present invention allows those of ordinary skill in the art to employ design molecular entities, compositions and or other modes of treatment that would reduce neuropathic pain by inhibiting, neutralizing or minimizing the role of SIP30 in a neuropathic pain cascade.

In other aspects of the present invention, the inventors propose methods of treatment of pain for neuropathic pain conditions, including spinal cord-mediated pain, peripheral nerve damage related pain, herniated disc related pain, Carpel tunnel syndrome, multiple sclerosis, fibromyalgia, herpes zoster, HIV-related neuropathies, painful traumatic mononeuropathy, painful polyneuropathy (particularly due to diabetes), central pain syndromes (potentially caused by virtually any lesion at any level of the nervous system), post-surgical pain syndromes (eg, post-mastectomy syndrome, post-thoracotomy syndrome, phantom pain), and complex regional pain syndrome (reflex sympathetic dystrophy and causalgia.

Another aspect of the present invention is directed to an expression vector comprising at least one DNA sequence encoding a siRNA molecule corresponding to at least a portion of a SIP30 nucleic acid sequence capable of inhibiting expression pain intermediaries in a cell operably linked to a genetic control element capable of directing expression of said siRNA molecule in a host cell.

Another aspect of the present invention is directed to a method for treating a subject suffering from neuropathic pain comprising administering into said subject at least a compound selected from the group consisting of an antisense sequence, a siRNA molecule, a peptide, a small molecule that corresponds and antagonizes the activity of at least a portion of a SIP30 nucleic acid sequence and or a SIP30 protein.

Another aspect of the present invention is directed to a system for treating a patient suffering from neuropathic pain comprising at least one antisense or siRNA molecule, a peptide, a small molecule alone or in combination with each other or further in combination with other neuropathic pain therapies and modalities and finally a means for introducing said compounds to the desired tissue of the patient.

In a further aspect the candidate compounds including antisense, siRNA molecule that corresponds to at least a portion of a the SIP30 nucleic acid sequence can be introduced into the desired tissue by means of an injection, a pump or a depot.

In the practice of the invention, a depot implant is implanted in a subject at or near a target site. Non-limiting examples of such sites include an inflamed nerve, constricted nerve at a cerebral or a spinal site, or the surrounding soft tissue.

In another embodiment of the invention the siRNA depot implant is positioned in the affected areas. Additional embodiments of the invention provide for positioning the drug depot implant in the shoulder, hip, other joints or spine of a patient.

In one embodiment, a targeted delivery system of one or more SIP30 antagonist molecules conveniently employ a catheter. In another embodiment, the targeted delivery system employs a syringe.

In one method of the invention, the targeted delivery system comprises a drug depot implant system administered locally by insertion of a catheter at or near a target site, the catheter having a proximal end and a distal end, the distal end having an opening to deliver a SIP30 antagonist in situ, the proximal end being fluidly connected to a pharmaceutical delivery pump. For example, the proximal end of the catheter may deliver the molecule to within 10 cm of a target site, more particularly, to within 5 cm of the target site.

In the employment of an implant of the invention, the SIP30 antagonist may inhibit other pain intermediaries mediated by INF-α, IL-1, IL-6 and other pain inducing cytokines.

In another embodiment, the suitable compounds further comprises a modified release pharmaceutical composition. The system can further comprise two or more combination of molecules. In still another embodiment, a catheter is provided rather than a depot. In this embodiment, a catheter has a proximal end and a distal end, the distal end having an opening to deliver a pharmaceutical in situ, the proximal end being fluidly connected to a pharmaceutical pump.

For the purposes of promoting an understanding of the principles of the invention, reference will be made to preferred embodiments and specific language will be used to describe the same. It will nevertheless be understood that no limitation of the scope of the invention is thereby intended, such alterations and further modifications of the invention, and such further applications of the principles of the invention as illustrated herein, being contemplated as would normally occur to one skilled in the art to which the invention relates.

The present invention is more specifically drawn to compositions and methods for the treatment of pain arising from inventors' discovery that inhibition of SIP30 results in reduction of pain of a neuropathic pain nature. In certain preferred embodiments, a SIP30 antagonist or a related molecule can be administered directly to a nerve or a tissue position near a nerve centrally or locally that is responsible of origination of neuropathic pain.

Based on the present invention, one skilled in the art can infer that molecular inhibition of SIP30 can also result in reduction of pain of a neuropathic pain nature. Accordingly, the treatment of pain in this invention applies to neuropathic pain conditions, including spinal cord-mediated pain, compression injuries, peripheral nerve damage related pain, herniated disc related pain, Carpel tunnel syndrome, multiple sclerosis, fibromyalgia, herpes zoster, HIV-related neuropathies, painful traumatic mononeuropathy, painful polyneuropathy (particularly due to diabetes), central pain syndromes (potentially caused by virtually any lesion at any level of the nervous system), post-surgical pain syndromes (eg, post-mastectomy syndrome, post-thoracotomy syndrome, phantom pain), and complex regional pain syndrome (reflex sympathetic dystrophy and causalgia. In certain embodiments, a substance to antagonize SIP30 or a related molecule can be administered directly to a nerve or a tissue position near a nerve.

The present invention is described more fully by way of the following non-limiting example. All references cited are hereby incorporated by reference in their entirety herein. The data in the following example showed that SIP30 is a molecular component for the development and maintenance of neuropathic pain, and that antagonizing SIP30 by antisense oligonucleotides produce pain relief in the rat's chronic constriction injury ("CCI") model of neuropathic pain. The inventors also showed that mammalian SIP30 sequences are highly related. Thus, this invention teaches the compositions and methods for treating pain of a neuropathic pain origin by antagonizing SIP30 in any mammalian species. Based on this invention, those skilled in the art can readily deduce that any known method for antagonism, including antagonizing the SIP30, the product of mRNA such as with oligonucleotides, or antagonizing the SIP30 protein with chemical compounds and/or antibodies, will lead to the pain-relieving effect disclosed in this invention.

Further, those skilled in the art can readily deduce that neuropathic pain relief can be achieved by antagonizing a molecule related to SIP30; such a molecule can be a synaptic vesicle-related protein, and/or a molecule generally known as a SNAREs (Ungar and Hughson, 2003; Brunger, 2005).

The present invention provides an advantageous strategy for reducing any type of pain associated with any medical condition or caused by any procedure that could induce or express any portion of the SIP30. SIP30 is abundantly available in certain mammalian tissues. In brain, SIP30 is highly expressed in the inferior and superior colliculi, which contain important relay nuclei of the auditory and visual systems. GST-pull-down and immunoprecipitation assays showed direct binding of SIP30 to SNAP25. Although SIP30 does not directly interact with syntaxin based on pull-down assays, syntaxin does co-immunoprecipitate with SIP30 suggesting that syntaxin is indirectly associated with SIP30, perhaps through SNAP25.

By way of example, the inventors of the present invention disclose compounds and methods for reducing neuropathic pain associated with peripheral nerve injury.

In at least one aspect of the invention localized delivery of an SIP30 antagonist will prevent, reduce or at least minimize the majority of negative side effects of systemic agents. In at least one embodiment, local delivery of SIP30 antagonist molecules can be used to achieve high concentrations of the SIP30 antagonist at the intended target site while using a low dose and minimizing risk of systemic side effects.

In addition, another aspect of the present invention embrace protracted release of the agent for long term relief of neuropathic pain by incorporating SIP30 antagonists alone or in combination with suitable anticonvulsant, anti-inflammatory, compounds targeting different ion channels, opioids, Na channel blockers, antidepressents, or anesthetic, more specifically, including but not limited to Mexiletine, Lidocaine, Tramadol, Morphine, Alfentanil, Ketamine, Methylprednisone, Adenosine, Glycine antagonists, Desipramine, Venlafaxine, gabapentin, into a biodegradable depot implant that will act as a depot for localized or central release of the agent.

Another aspect of the present invention provide reagents, methods and systems for inhibiting expression of NPII or cytokines responsible for inducing neuropathic pain in a cell using antisense, or siRNA molecules that correspond to at least a portion of SIP30 cytokine nucleic acid sequence of SNAREs. Applicants have found that SIP30 antagonists targeted to NPII and related cytokine mRNA are effective in inhibiting expression of neuropathic pain inducing cytokine, thereby providing improved methods for treating pain in a subject. The methods of this aspect of the present invention can be performed utilizing routine techniques in the field of molecular biology. Basic texts disclosing general molecular biology methods include Sambrook et al., Molecular Cloning, A Laboratory Manual (3d ed. 2001) and Ausubel et al., Current Protocols in Molecular Biology (1994). More specialized texts relevant to the present invention include Sohail, Gene Silencing by RNA Interference: Technology and Application (2004).

In one broad aspect, the invention relates to isolated nucleic acid molecules comprising a nucleic acid sequence encoding complementary to nucleotides 11-31 of the coding region of the SNAP25 inteacting protein (GenBank accession number BC063144). In a specific aspect, the isolated nucleic acid molecule encodes proteins that neutralizes the up-regulation of SIP30 associated with neuropathic pain phenomenon. In addition, the invention is directed to vectors comprising these nucleic acid molecules, as well as host cells comprising the vectors. In another specific aspect, the invention relates to the proteins themselves.

In a second broad aspect, the invention relates to antibody that is specific for SIP30 proteins and SNAREs including rat SNAP and all homologous or orthologous sequences for mammalian SIP30 as shown in FIG. 2. In one specific aspect, the antibody is a polyclonal antibody. In another specific aspect, the antibody is a monoclonal antibody.

In a third broad aspect, the invention relates to method of reducing the upregulation of SIP30 locally or centrally in specific neuropathic pain originating tissues, for example ipsilateral side of the spinal cord. In one specific aspect, the isolated nucleic acid molecule is in a vector, which may be a plasmid or a virus, such as adenovirus or retrovirus. The transfect ion may occur ex vivo or in vivo by direct injection of the isolated nucleic acid molecule. In an alternative approach, direct administration of the SIP30 antagonist is possible.

In another broad aspect of the invention, the inventors discover a process for determining suitable SIP30 antagonists for their ability to interact with a SIP30-like molecule protein, including SNAREs comprising: a) providing a SIP30-like molecule polypeptide comprising the contiguous amino acid sequence of any from the group of SEQ. ID. B1 through SEQ. ID. B130; and b) testing the ability of said substance to interact with a SIP30-like molecule. In a more specific feature of this embodiment the step of testing the ability of said substance to interact with a SIP30-like molecule involves determining the interaction affinity of said substance to a SIP30-like molecule.

A yet another embodiment, the inventors disclose a process for determining a substance's ability to interact with a SIP30-like molecule comprising: a) providing a recombinant SIP30-like molecule polypeptide encoded by a nucleic acid sequence comprising at least 35 contiguous nucleotides of any from the group of SEQ. ID. A1 through SEQ. ID. A130; b) contacting said substance with said recombinant SIP30-like molecule polypeptide; and c) detecting the ability of said substance to bind to said recombinant SIP30-like molecule polypeptide. In this aspect of the invention, the nucleic acid sequence comprises at least 45 contiguous nucleotides of any from the group of SEQ. ID. A1 through SEQ. ID. A130. In yet another aspect of this embodiment, the nucleic acid sequence comprises at least 50, 75, or 100 contiguous nucleotides of any from the group of SEQ. ID. A1 through SEQ. ID. A130.

Another aspect of the invention is directed to processes for detecting the ability of suitable SIP30 antagonists to interact with a SNAREs and SIP30 molecule polypeptide by measuring a) the ability of said recombinant SIP30-like molecule polypeptide to interact with said substance; b) the ability of said substance to activate ion channels in a cell membrane; or c) modulation of channels in the cell membrane of part b), specifically, wherein the recombinant SIP30-like molecule polypeptide is chimeric.

Another aspect of the present invention is directed to process for determining a substance's ability to bind to a SIP30-like molecule comprising: a) expressing in cells a recombinant SIP30 polypeptide encoded by a nucleic acid sequence comprising at least 25 contiguous bases of any from the group of SEQ ID A1 through SEQ ID A130; b) contacting said substance with said recombinant SIP30-like molecule polypeptide; and c) detecting the ability of said substance to interact with said recombinant SIP30-like molecule polypeptide. In this aspect of the invention, the nucleic acid sequence can comprise at least 40, 45, 50, 75 or 100 contiguous nucleotides of any from the group of SEQ ID A1 through SEQ ID A130.

A preferred embodiment the present invention provides a an antisense oligodeoxynucleotide complementary to nucleotide 11031 of the coding region of the rat SIP30. Another aspect of the present invention is directed to siRNA molecule corresponding to at least a portion of a SIP30 nucleic acid sequence, mRNA encoding SNAREs, including SNAP25 capable of inhibiting expression of said proteins or cytokines in a cell responsible for neuropathic phenomenon.

siRNAs of the present invention are typically short (19-29 nucleotides), double-stranded RNA molecules that cause sequence-specific degradation of complementary target mRNA known as RNA interference (RNAi) (Bass, Nature 411:428 (2001)). Accordingly, in some embodiments, the siRNA molecules comprise a double-stranded structure comprising a sense strand and an antisense strand, wherein the antisense strand comprises a nucleotide sequence that is complementary to at least a portion of a peptide, protein or cytokine nucleic acid sequence and the sense strand comprises a nucleotide sequence that is complementary to at least a portion of the nucleotide sequence of said antisense region, and wherein the sense strand and the antisense strand each comprise about 19-29 nucleotides.

The siRNA molecules targeted to NPII, or pain inducing cytokines or proteins can be designed based on criteria well known in the art (e.g., Elbashir et al., EMBO J. 20:6877 (2001)). For example, the target segment of the target mRNA preferably should begin with AA (most preferred), TA, GA, or CA; the GC ratio of the siRNA molecule preferably should be 45-55%; the siRNA molecule preferably should not contain three of the same nucleotides in a row; the siRNA molecule preferably should not contain seven mixed G/Cs in a row; the siRNA molecule preferably should comprise two nucleotide overhangs (preferably TT) at each 3' terminus; the target segment preferably should be in the ORF (open reading frame) region of the target mRNA and preferably should be at least 75 bp after the initiation ATG and at least 75 bp before the stop codon; and the target segment preferably should not contain more than 16-17 contiguous base pairs of homology to other coding sequences. Based on some or all of these criteria, preferred pain inducing cytokine siRNA target sequences can be identified.

Accordingly, another aspect of the present invention provides a method for inhibiting expression of a SIP30 pain inducing protein or cytokine, or other intermediaries in a cell comprising introducing into a cell at least one antisence or siRNA molecule that corresponds to at least a portion of a pain inducing nucleic acid sequence. Although any cell can be targeted, the cell into which the such molecules should be introduced is preferably a central nervous system regions that at risk of SIP30 upregulation, more preferably a spinal cord or locally at areas that the pain inducing protein or cytokines manifest their presence. In preferred embodiments, the regions is from a subject suffering from an injury, preferably a human patient.

The compounds and molecules produced herein can be introduced into cells in vitro or ex vivo using techniques well-known in the art, including electroporation, calcium phosphate co-precipitation, microinjection, lipofection, polyfection, and conjugation to cell penetrating peptides (CPPB).

Alternatively, such molecules targeted to pain inducing cytokines can be introduced into cells in vivo by endogenous production from an expression vector(s) encoding the sense and antisense sequences.

Genetic control elements include a transcriptional promoter, and may also include transcription enhancers to elevate the level of mRNA expression, a sequence that encodes a suitable ribosome binding site, and sequences that terminate transcription. Suitable eukaryotic promoters include constitutive RNA polymerase II promoters (e.g., cytomegalovirus (CMV) promoter, the SV40 early promoter region, the promoter contained in the 3' long terminal repeat of Rous sarcoma virus (RSV), the herpes thymidine kinase (TK) promoter, and the chicken beta-actin promoter), tissue-specific RNA polymerase II promoters, and RNA polymerase III promoters (e.g., U6, H1, 7SK and 7SL).

In some embodiments, the sense and antisense strands may be encoded by different expression vectors (i.e., co-transfected). In other embodiments, the sense and antisense strands of siRNA molecules are encoded by the same expression vector. The sense and antisense strands can be expressed separately from a single expression vector, using either convergent or divergent transcription.

Alternatively, the sense and antisense strands can be expressed together from a single expression vector in the form of a single hairpin RNA molecule, either as a short hairpin RNA (shRNA) molecule (e.g., Arts et al., Genome Res. 13:2325 (2003)) or a long hairpin RNA molecule (e.g., Paddison et al., Proc. Natl. Acad. Sci. USA 99:1443 (2002)).

Neuropathic Pain inducing intermediaries, cytokine polypeptide (or fragments thereof) can be detected and quantified using various well-known immunological assays, such as, e.g., enzyme-linked immunosorbent assay (ELISA), radio-immunoassay (RIA), immunoprecipitation, immunofluorescence, and Western blotting. Anti-pro-inflammatory cytokine anti-bodies (preferably anti-human pro-inflammatory cytokine) for use in immunological assays are commercially available from, e.g., EMD Biosciences (San Diego, Calif.), Upstate (Charlottes-ville, VA), Abcam (Cambridge, Mass.), Affinity Bioreagents (Golden, Colo.) and Novus Biologicals (Littleton, Colo.), or may be produced by methods well-known to those skilled in the art.

In another aspect, the invention provides a screening method comprising: providing a sample containing at least a portion of SIP30 and/or at least a portion of a SIP30 protein; adding a test compound to at least a first portion of the sample; and comparing at least one parameter from at least the first portion of the sample with the at least one parameter from at least a second portion of the sample, wherein at least the second portion of the sample does not include the test compound.

A magnitude of a difference between the at least one parameter from at least the first portion of the sample and the at least one parameter from at least the second portion of the sample is an indication of, inter alia, the test compound's ability to alter SIP30 expression, activity or up-regulation.

In another aspect, the invention provides a kit comprising at least a portion of SIP30 and/or at least the portion of SIP30 protein, and at least a quantity of a control compounds.

In yet another aspect, the invention provides a method for use in assessing the risk of developing post surgical neuropathic pain in a subject comprising detecting a test amount of a SIP30 gene product in a sample from the subject; and comparing the test amount with a normal amount of SIP30 gene product in a control sample, whereby a finding that the test amount is outside of the normal range for the SIP30 gene product provides a positive indication in the diagnosis of a risk to post surgical neuropathic pain.

The use of antisense or siRNA molecules alone or in combination with other anticonvulsants, anti-inflammatory agents, anesthetics, to inhibit cellular expression of neuropathic pain inducing cytokine finds utilities as methods for the treatment inflammation in subjects. Accordingly, another aspect of the present invention provides a method for treating a patient suffering from neuropathic pain comprising introducing into said patient at least an effective amount of SIP30 antagonist molecule that corresponds to at least a portion of a SIP 30 nucleic acid sequence. Such a method for treatment of inflammation can be performed using systems that provide for the delivery of such molecules targeted to the tissue of interest. Accordingly, another aspect of the present invention provides a means for introducing the effective amount of such formulations into the tissue of the patient. In preferred embodiments, the patient is human.

Numerous well-known methods exist for tissue gene delivery, such as for example, catheter, syringe or depot implant. A preferred delivery system includes a depot implant. A depot implant of the present invention comprises a physical structure to facilitate implantation and retention in a desired location of a subject. Drug depot implant may contain microspheres, the microspheres may further contain a isolated nucleic acids, a siRNA molecule that provides a concentration gradient for targeted delivery of the agent to the subject. In yet another aspect of the present invention, the microspheres are injected into the tissue of interest.

In another aspect of the invention those of ordinary skill will appreciate that different combinations of the products in form of immediate release or sustained-release formulations are also suitable for this invention. For example, the practitioner may formulate the at least one SIP30 antagonist as a combination of a gel and microspheres loaded with the at least one anticonvulsant, antidepressant, anti-inflammatory, opioid, or anesthetic wherein the combination of gel and microspheres are placed in the region of interest. In the practice of the invention, the administration is localized and sustained.

The reagents, methods and systems of the present invention are also useful for applications in many organs of the subject.

Specific embodiments according to the methods of the present invention will now be described in the following examples. Although the invention herein has been described with reference to particular embodiments, it is to be understood that these embodiments are merely illustrative of the principles and applications of the present invention. It is therefore to be understood that numerous modifications may be made to the illustrative embodiments and that other arrangements may be devised without departing from the spirit and scope of the present invention as defined by the following claims.

EXAMPLES

Example 1

Antagonizing SIP30 to Suppress Development and Maintenance of Peripheral Nerve Injury-Induced Neuropathic Pain Materials and Methods Experimental animals. Adult male Sprague-Dawley rats, 200-280 g, were housed two per cage with food and water available ad libitum, with a 12:12 h day/night cycle and at a constant room temperature.

Intrathecal implantation. An intrathecal catheter (PE-10 tube) was inserted through the gap between the L4 and L5 vertebrae and extended to the subarachniod space of the lumbar enlargement (L4 and L5 segments) under sodium pentobarbital (40 mg/kg, i.p.) anesthesia. The catheter was filled with sterile normal saline (approximately 4 ul), and the outer end was plugged. The cannulated rats were allowed to recover for 4 days and were housed individually. Rats that showed any neurological deficits resulting from the surgical procedure were excluded from the experiments.

Chronic constriction injury (CCI) of the sciatic nerve. Rats were deeply anesthetized with pentobarbital sodium (45 mg/kg i.p.) and the right sciatic nerve exposed at the mid-thigh level by blunt dissection of the biceps femoris. For CCI, four chromic gut (4-0) ligatures were tied loosely around the nerve ~1 mm apart, proximal to its trifurcation, as described by Bennett and Xie (1988). For sham surgery, the sciatic nerve was isolated but not ligated. After CCI or sham surgery, the overlying muscles and skin were closed respectively in layers with 4-0 silk sutures and dusted with antibiotic power.

Antisense oligodeoxynucleotide (ODN) preparation and delivery. An antisense sequence (AS 5'-TTT CTC CGC GTC CGC CAT GGT-3') SEQ. ID No. 131, complementary to nucleotides 11-31 of the coding region of the rat SNAP25 interacting protein 30 (SIP30, GenBank accession number BC063144), and a corresponding mismatch sequence SEQ. ID. No. 132 (MM, 5'-TTT CCT CGC GTC CCG CAT GGT-3') were synthesized and purified by Integrated DNA Technologies, Inc., Coralville, Iowa, USA).

All of the ODNs were screened against the GenBank Database using the BLAST algorithm to exclude non-specificity of the antisense ODNs and to show that missense ODNs did not match any registered nucleotide sequences. The ODNs were reconstituted in 0.9% normal saline (NS) before administration. The rats were injected intrathecally with NS (10 ul), AS (50 ug/10 ul), and MM (50 ug/10 ul), respectively, followed by 5 ul NS for flushing, every 24 hrs for 4 days [delivering protocol I: from day 0 (6 hrs before CCI operation) to day 3 post-CCI operation; delivering protocol II: from day 4 to day 7 post-CCI operation].

RNA extraction for real-time PCR analysis. Rats were sacrificed on the 3rd or 7th day after CCI or sham operation. In order to assess the development of neuropathic pain and effects of antisense, rats were tested for both mechanical allodynia and thermal hyperalgesia as described in 2.6 before sacrificed. The spinal cord from naïve, sham, or CCI rats treated with AS, MM, or NS was dissected and split into two halves, one ipsilateral and one contralateral to the CCI side. The DRG (L4-L6) from the same treatment animals were also dissected. A single sample of the ipsilateral or contra-lateral DRG was collected from two rats.

After dissection, all tissues were rapidly frozen in dry ice and stored at −80° C. until further processing. Frozen spinal cords were directly homogenized in 1 ml TRIZOL reagent (Invitrogen, Life Technologies, Carlsbad, Calif., USA). Total RNA was extracted following manufacturer's protocol with minor modifications. Briefly, following chloroform extraction, RNA was precipitated with isopropanol and the pellet washed two times in 70% ethanol. After air drying, RNA was re-suspended in ultrapure water. Both the quality and quantity of the total RNA were examined by gel electrophoresis and by A 260 measurements (Agilent 2001 Bioanalyzer, Palo Alto, Calif.). Extracted RNA was treated with DNase I (DNA-free, Ambion) to remove genomic DNA. cDNA was synthesized with random decamers using the Ambion RETROscript reverse transcription kit accord-ing to the manufacturer's instructions. Negative control reactions were run without RNA to test for contamination of reagents.

Real-time PCR. Real-time PCR analysis was performed on a Cepheid Smart Cycler. The threshold cycles (Ct) were calculated using the Smart Cycler Data Analysis Software 2.0 (Cepheid). The PCR reaction was performed in a final volume of 20 µl using LightCycler DNA Master SYBR Green I kit containing: 12.6 µl of PCR grade water, 2.4 µl of MgCl2 (25 mM), 2 µl of 10× LightCycler DNA Master SYBR Green I [Taq DNA polymerase, reaction buffer dNTP mix (with dUTP instead of dTTP), SYBR Green I dye, and 10 mM MgCl2], 2 µl of cDNA template, 0.5 µl of forward and reverse primer (100 ng/µl) respectively.

The amplification protocol included 150 sec at 95° C. to activate the Taq DNA polymerase, then 40 cycles of 10 sec denaturation at 95° C., 15 sec annealing at 58° C., and 20 sec extension at 72° C. In all cases, a linear relationship between the sample cDNA quantity and the Ct was observed first. Each sample was run in triplicates and Ct values were averaged from each reaction.

For controls, no-template controls were run in which water replaced template. Results of the RT-PCR analysis were expressed as Ct values, which were used to determine the amount of target gene mRNA in relation to the amount of reference gene mRNA. In this present study, β-actin was used as reference gene to normalize expression levels. The relative gene expression level was computed from the target and β-actin using the following formula (Livak and Schmittgen, 2001; Marvizon et al., 2002; Beltramo et al., 2003): mRNA relative expression=2−(Ct of target−Ct of β-actin). Primers were designed by Invitrogen Custom Primer Designer.

Von Frey hair test of mechanical sensitivity. The hind paw withdrawal threshold was determined using a calibrated series of von Frey hairs (Stoelting, Ill., USA) ranging from 0.6 to 18 g. Animals were placed individually into wire mesh-bottom cages, and allowed to acclimatize for ~30 min. The series of von Frey hairs was applied to the central region of the plantar surface of the left hind paw in ascending order of force (0.6, 0.9, 1.3, 2.2, 4.8, 6, 7.2, 9, 13, and 18 g) with a single trial of up to 6 sec. The hair was applied only when the rat was stationary and standing on all four paws. A withdrawal response was considered valid only if the hind paw was completely removed from the mesh-bottom. When a withdrawal response was established, the paw was retested, starting with the next descending von Frey hair until no response occurred. A trial consisted of application of a von Frey hair to the hindpaw five times at 15 s intervals to each hindpaw. The hindpaw withdrawal threshold was defined as the lowest force that caused at least three withdrawals out of the five consecutive applications. Once the threshold was determined for the left hind paw, the same testing procedure was repeated on the right hind paw after 5 min.

Hargreave's test for hind paw thermal sensitivity. After acclimation to the test chamber, thermal hyperalgesia was assessed by measuring the latency of paw withdrawal in response to a radiant heat source. Rats were placed individually into Plexiglas cages on an elevated glass platform, under which a radiant heat source (model 336 combination unit, IITC/life Science Instruments, Woodland Hill, Calif., USA) was applied to the glabrous surface of the paw through the glass plate. The heat source was turned off when the rat lifted the foot, allowing the measurement of time from onset of radiant heat application to withdrawal of the rat's hind paw. This time was defined as the hind paw withdrawal latency. The heat was maintained at a constant intensity, which produced a stable withdrawal latency of approximately 8-10 s in the absence of CCI. A 20 s cut-off was used to prevent tissue damage in the absence of a response. Rats were tested individually in groups of four, such that the stimulation was delivered once to the left hind paw (control) of each rat and then to the right hind paw (CCI) with a 5 min interval. This process was then repeated two more times, and three trials were averaged for each limb.

Results

Identification of Neuropathic Pain in a Rodent Model

In an effort to uncover novel molecular components of signaling pathways that are involved in regulating neuropathic pain, the inventors utilized chronic constriction injury (CCI) as a rodent model of neuropathic pain (Bennett and Xie, 1988; Moalem et al., 2004; Xie et al., 2005), to search for differentially expressed genes in the spinal cord of the CCI rats. Since the inventors wished to identify genes that are involved in the development phase of the neuropathic pain, they first determined the time course of neuropathic pain development in the CCI model. Using S-D rats that had received unilateral CCI surgery, they measured hindpaw thermal and tactile nociceptive sensitivity, from 2-day post-CCI surgery.

Figure 1B:
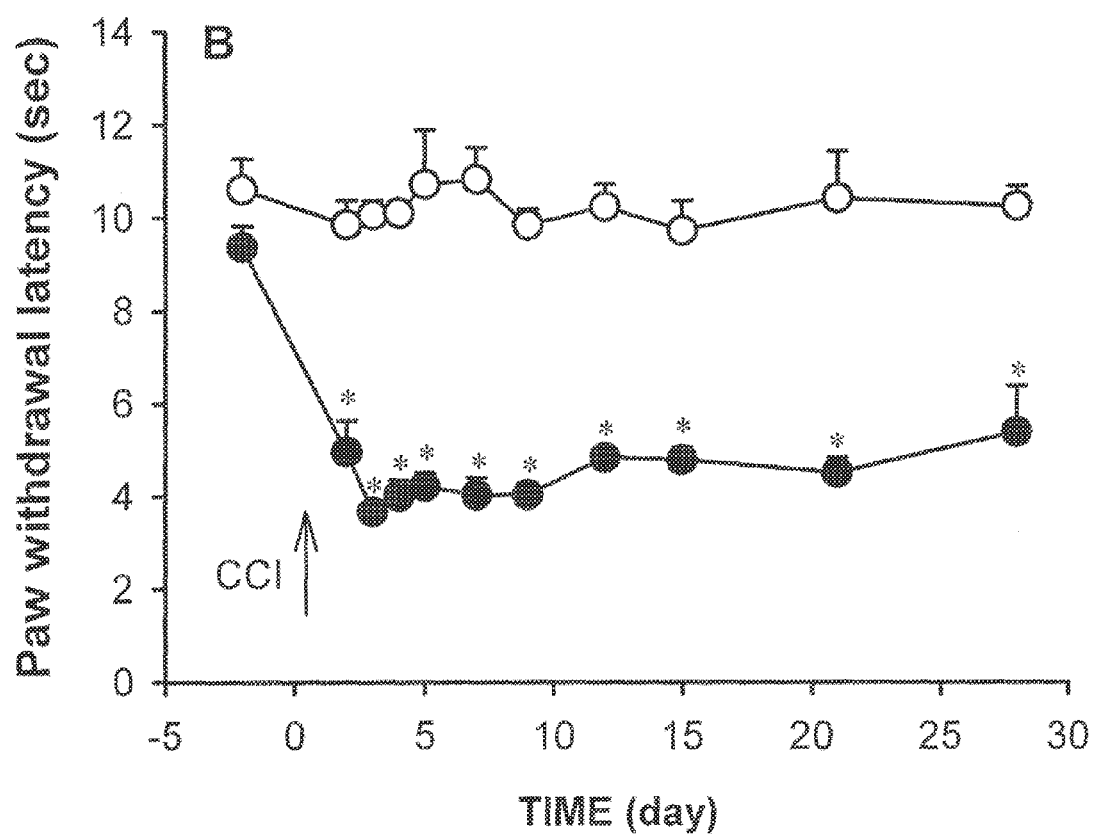

As can be seen in FIG. 1, at 2-day post-CCI surgery, for the CCI hind paw compared with the control paw (i.e., no surgery), both thermal and tactile nociceptive sensitivity have greatly increased, to approaching almost maximum. These results are consistent with the previous studies (Khalil et al., 1999) that mechanical allodynia and thermal hyperalgesia developed within a few days following CCI. Based on this time course information for neuropathic pain development, the inventors chose post-CCI day 3 as the time point, and isolated RNA from the lumbar enlargement portion of the control and CCI animals to perform microarray analysis using a custom-constructed cDNA library microarray as previously described (Hou et al., 2004; Jin et al., 2005; Wang et al., 2005).

One of the cDNA clones that were identified in this process is SIP30, a molecule that has been previously reported that interacts with SNAP25 (Lee et al., 2002), which has been shown to be present in several areas of the rat brain (Lee et al., 2002), and its molecular function was hitherto unknown.

As shown in FIG. 2, SIP30 orthologues are present in several species, including chimpanzee, monkey, and several non-primate mammals. The sequence is highly homologous. Extensive search of GenBank and other public sequence databases indicated that SIP30 sequence is present in primates and other mammals.

Figure 3A:
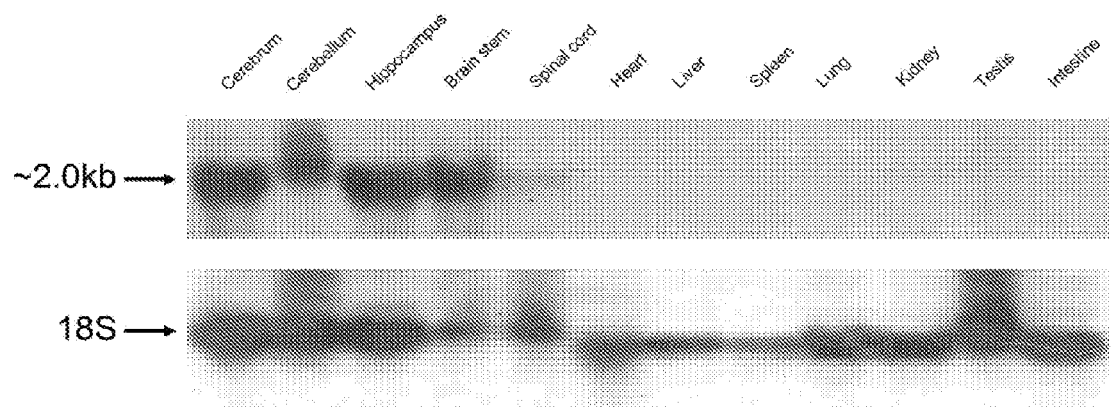
FIG. 3. illustrates expression pattern of SIP30 in normal rats. (A) Northern blot analysis of SIP30 expression in various rat tissues. The 2 kb mRNA band of SIP30 was marked with an arrow, and 18S ribosomal RNA was used as an internal control for sample loading. Source of tissue for RNA was indicated across the top of the gel for each lane. (B) SIP30 expression in the DRG. Immunological staining using antibodies against SIP30 (a), IB4 (b), and CGRP (c). Pair-wise superimposed composite images are shown as follows: SIP30 with IB4 (d), SIP30 with CGRP (e), and IB4 with CGRP (f). White arrowheads mark the cells with double staining. (C) SIP30 expression in the spinal cord. Immunological staining using antibodies against SIP30 (a), substance P (b), and CGRP (c). Superimposed composite images are shown as follows: SIP30 with substance P (d), SIP30 with CGRP (e), and triple composite of SIP30 with substance P and CGRP (f).
Figure 3B:
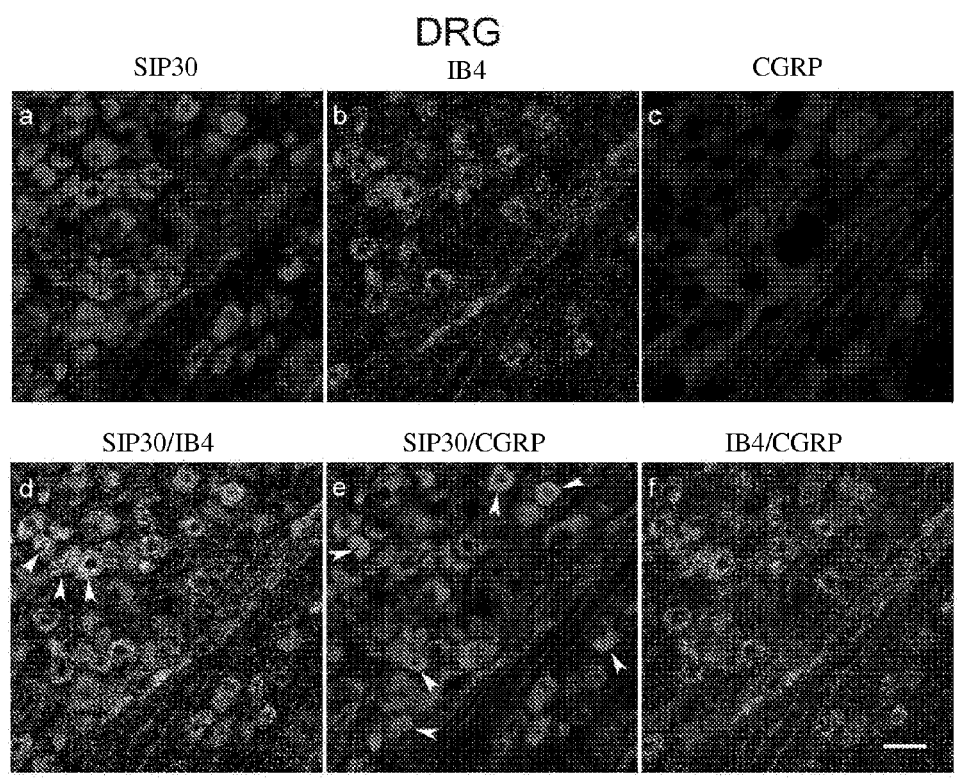
Figure 3C:
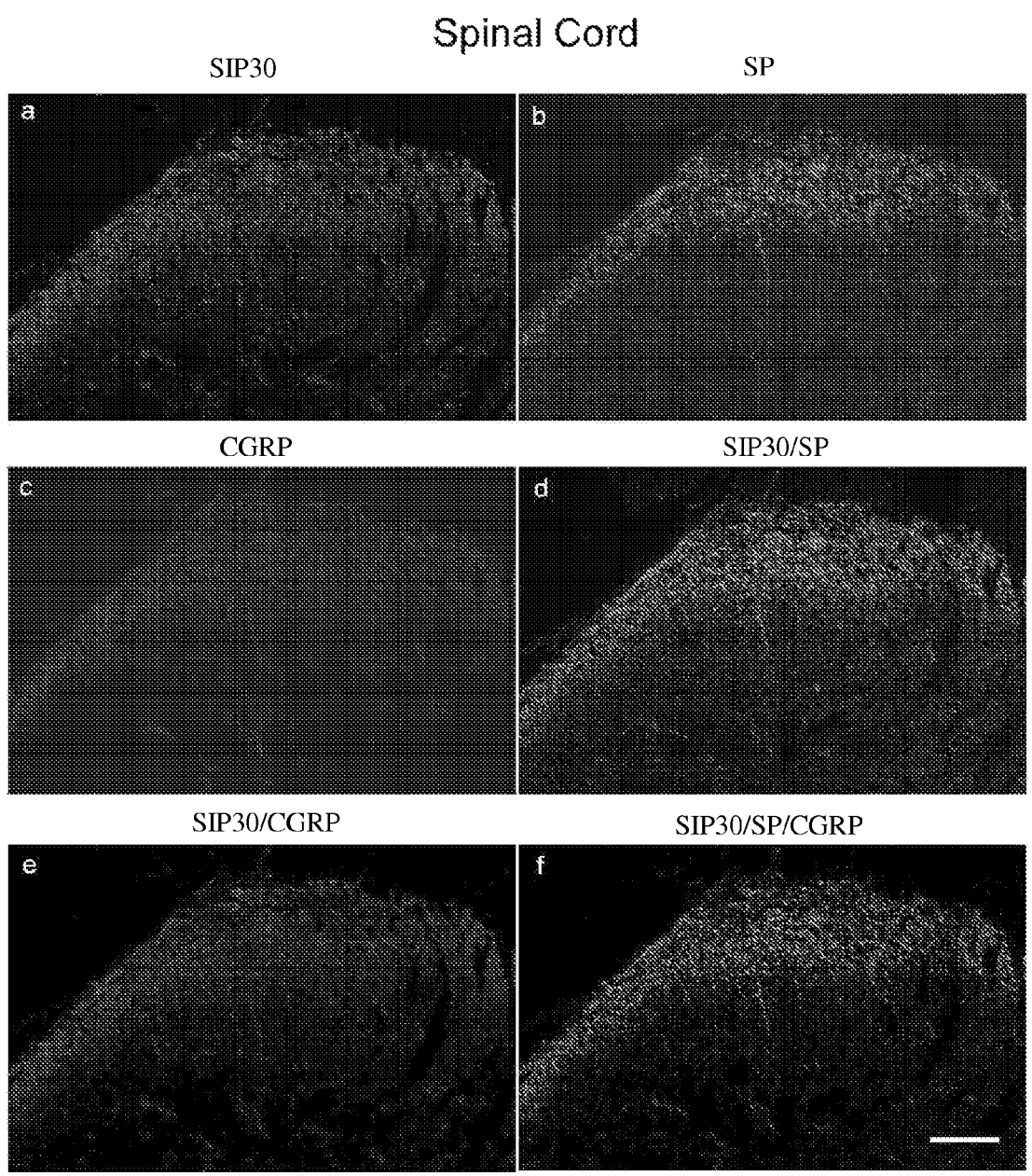
Figure 4A:
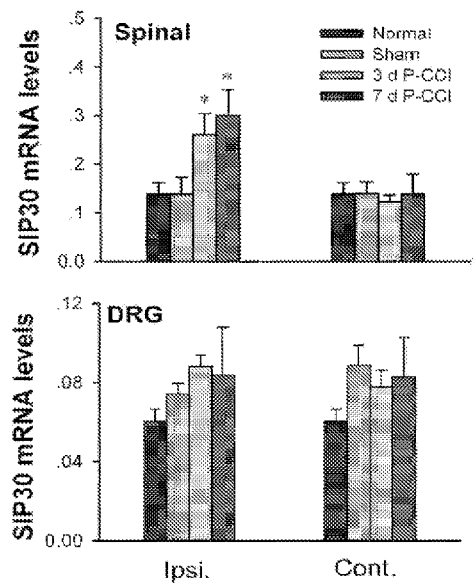
FIG. 4. illustrates SIP30 was up-regulated during CCI. (A) SIP30 mRNA levels in spinal cord (upper panel) and DRG (lower panel). Real-time PCR amplification results for SIP30 mRNA are shown relative to the mean levels in normal animals. Spinal cord tissues from rats receiving no surgery (normal), sham-CCI surgery (sham), or CCI surgery (3 days and 7 days post surgery, respectively) were collected, and RNA was isolated from the ipsilateral and contralateral side of the sham or CCI surgery for real-time PCR analysis. Significant difference ($p<0.05$ vs. normal or Sham group) was observed in the ipsilateral but not contralateral spinal cord for both day 3 and day 7 after CCI surgery. No significant difference was observed in DRG. (B) Western blot analysis of SIP30 protein levels in the spinal cord. Spinal cord tissues from rats receiving sham or CCI surgery (3 days post surgery) were collected, and protein was isolated from the ipsilateral and contralateral side of the sham or CCI surgery for Western blot analysis. Top panel, representative Western blots of SIP30 protein. β-Actin was used as the internal control. Bottom panel, quantitative results of SIP30 protein, significant difference ($p<0.05$ vs. sham group) for the ipsilateral side of the spinal cord. (C) Western blot analysis of SIP30 protein levels in DRG. DRG tissues from rats receiving sham or CCI surgery (3 days post surgery) were collected, and protein was isolated from the ipsilateral and contralateral side of the sham or CCI surgery for Western blot analysis. Top panel, representative Western blots of SIP30 protein. β-Actin was used as the internal control. Bottom panel, quantitative results of SIP30 protein. No significant difference was observed on either ipsilateral or contralateral side of DRG. (D) SIP30 protein level was elevated in the ipsilateral side of spinal cord dorsal horn after CCI. (a) Immunofluorescence shows basal expression of SIP30-IR cells in naïve rats; (b & b') Immunofluorescence indicate an increase in SIP30-IR cells in the dorsal horn on the ipsilateral (CCI) side (b, 5×; b', 10×) (c) Quantification of SIP30 expression level, as indicated by the number of SIP30-IR cells (per 30 μm section) in the superficial (laminae I-II) and deep (laminae IV-V) dorsal horn. $p<0.05$; ANOVA, compared to control (n=5). (E) SIP30 localization in CCI spinal cord. (a) SIP30 is co-localized with NeuN, a neuronal marker, in the spinal dorsal horn. 3 days after CCI (20×). (b) Enlarged image of boxed area in (a) as superimposed image (left panel) or separate images (right top and bottom panels) (40×). (c) Double immunofluorescence staining shows the SIP30 is not co-localized with GFAP in the dorsal horn 3 days after CCI. (d) Double immunofluorescence staining shows the SIP30 is not co-localized with OX-42 in the dorsal horn 3 days after CCI. SIP30 did not show overlap staining with either GFAP or OX-42.
Figure 4B:
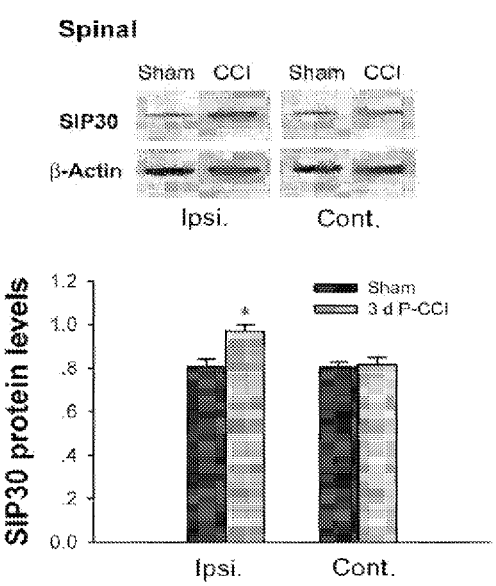
Figure 4C:
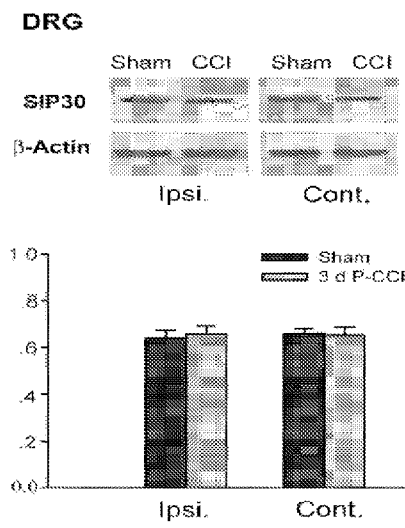
Figure 4D:
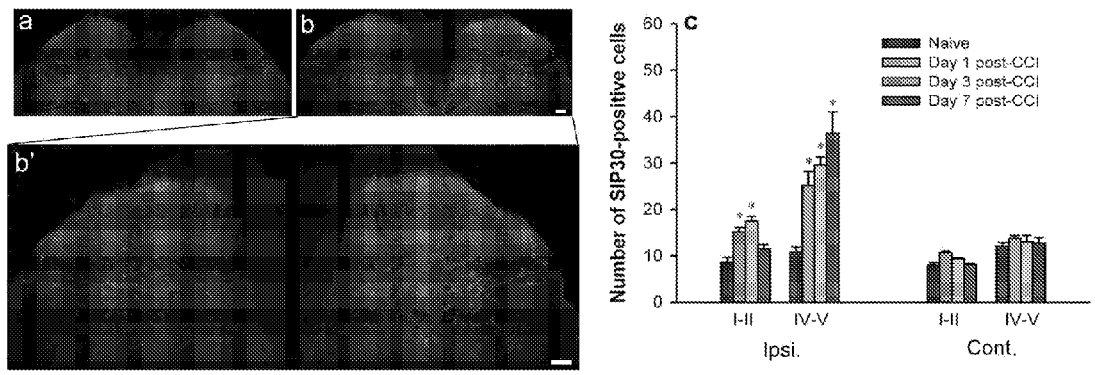
Figure 4E:
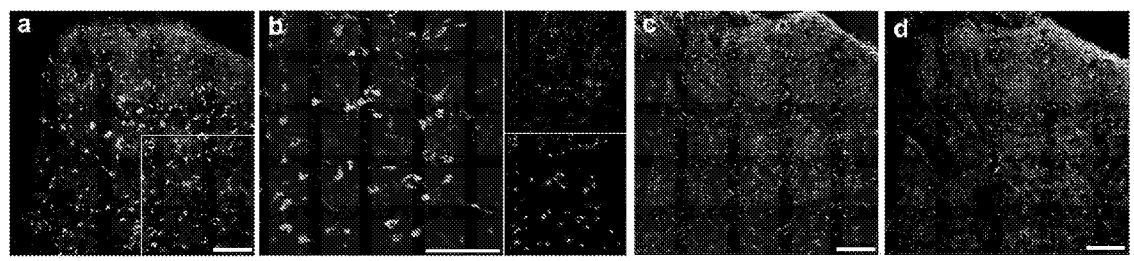
Figure 5A:
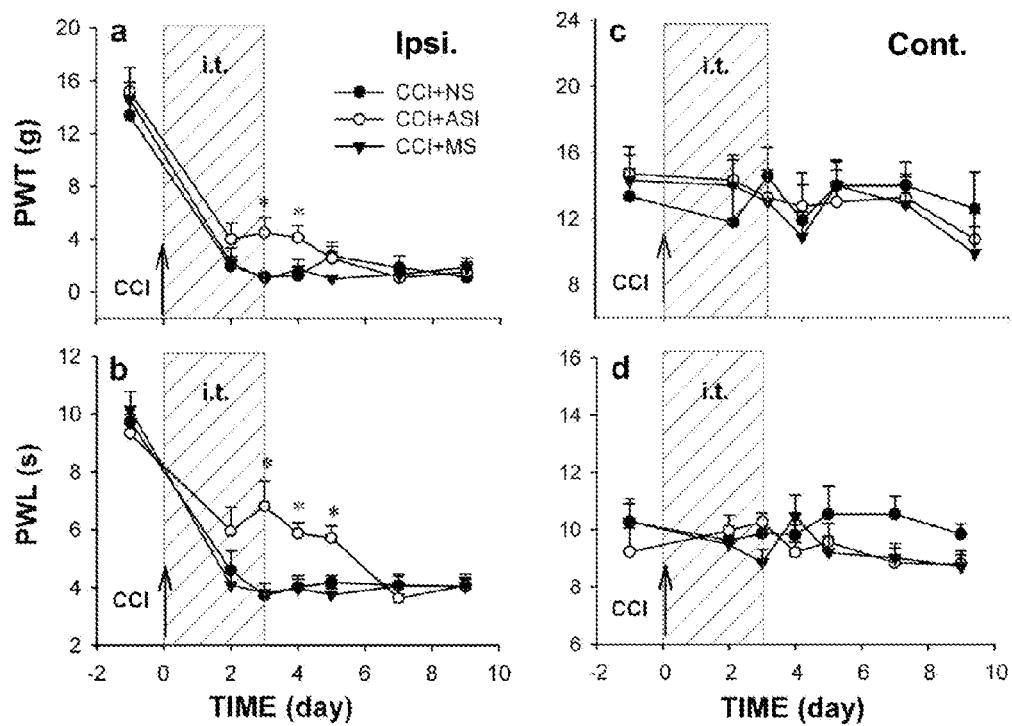
FIG. 5. illustrates SIP30 participates in the regulation of development and maintenance of peripheral nerve injury-induced neuropathic pain. (A) Following the intrathecal injection of SIP30 antisense oligonucleotide (AS ODN) for 4 days (from day 0 to day 3 post-CCI), the development of mechanical allodynia (a) and thermal hyperalgesia (b) was reduced in ipsilateral paw to CCI ("Ipsi."), whereas NS and MM ODN had no effect. $p<0.05$ vs. either NS or MM group. (c, d) No change was seen in contralateral paw ("Cont.") after the same treatment. (B) Intrathecal injection of a second SIP30 AS ODN (SIP30 ASII, directed towards nucleotides 143-162 of the coding region of the SIP30 gene) for 4 days (from day 0 to day 3 post-CCI), the development of mechanical allodynia (a) and thermal hyperalgesia (b) was reduced in ipsilateral paw to CCI, but random oligonucleotide (RD ODN) had no effect. $p<0.05$, $p<0.01$ vs. RD group. (c, d) No change was seen in contralateral paw after the same treatment. (C) After mechanical allodynia and thermal hyperalgesia were developed, intrathecal injection of SIP30 AS ODN for 4 days (from day 3 to day 7 post-CCI) significantly inhibited both mechanical allodynia and thermal hyperalgesia in the ipsilateral paw to CCI, but NS and MM ODN had no effect $p<0.05$ vs. either NS or MM group. (c, d) No change was seen in contralateral paw after the same treatment. (D) In naïve rats, intrathecal injection of SIP30 AS ODN for 4 days did not affect the basal responses to Von Frey (a) or thermal stimuli (b) in both paws.
Figure 5B:
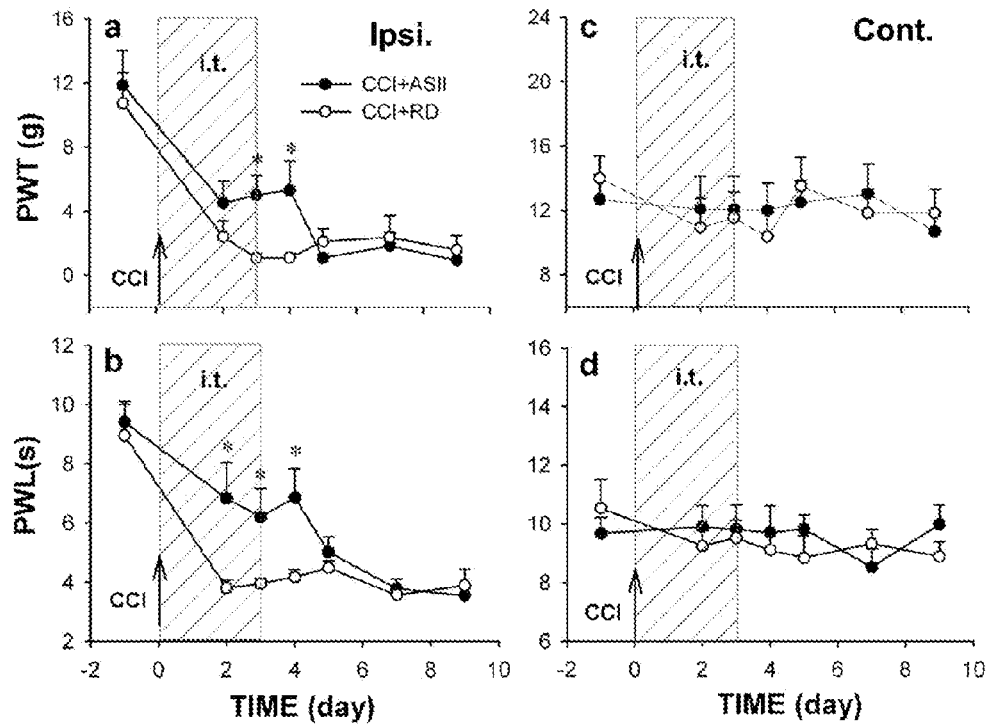
Figure 5C:
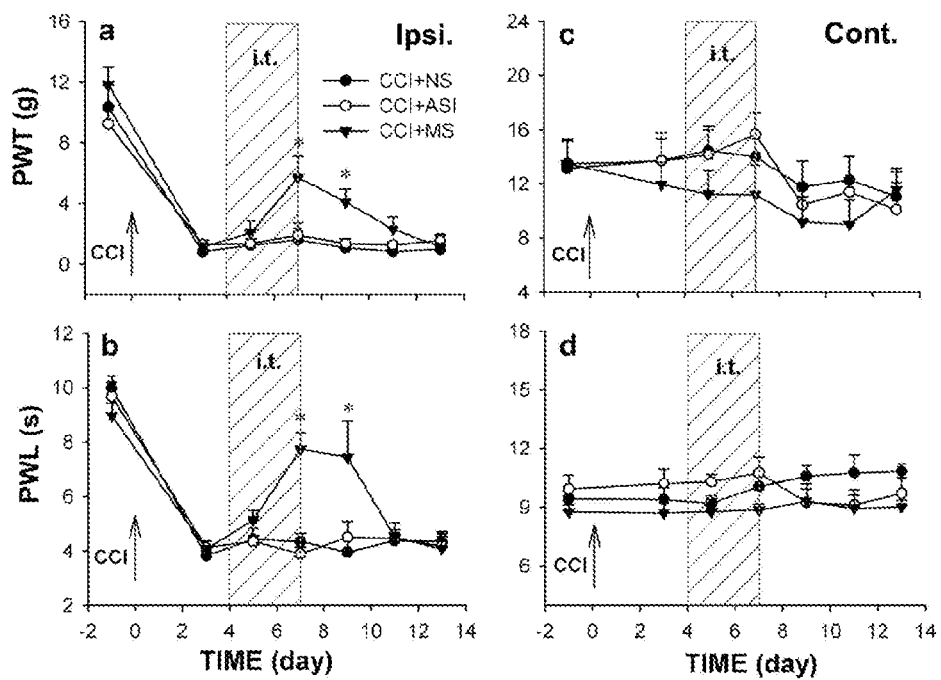
Figure 5D:
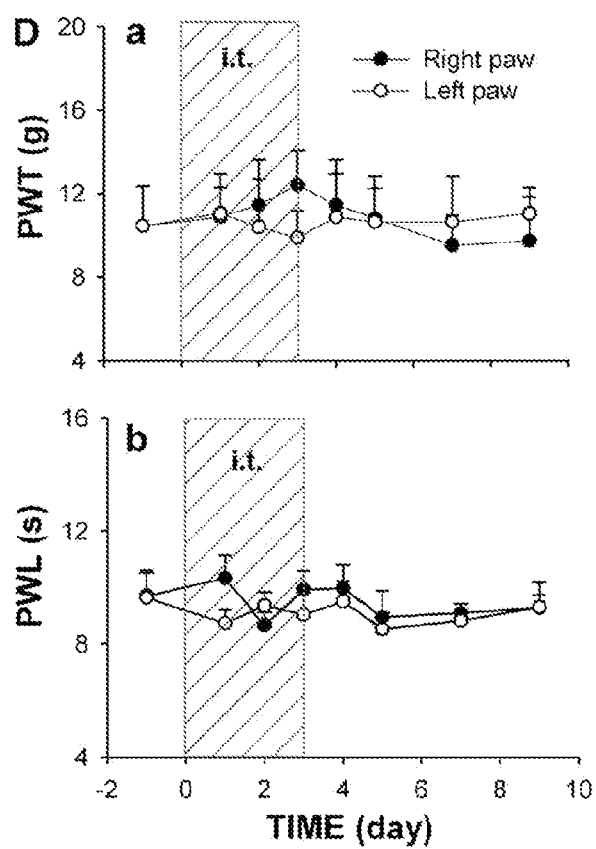
Figure 6A:
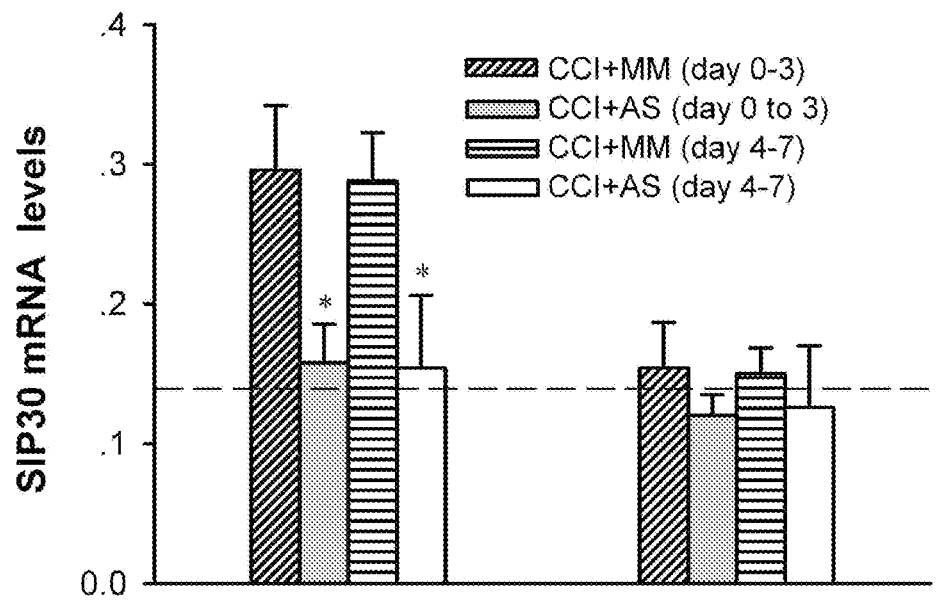
FIG. 6. illustrates anti-SIP30 antisense oligonucleotide knock down of SIP30 and SNAP25 levels. (A) SIP30 mRNA was increased after CCI, and the increase was reduced by antisense oligonucleotide (ODN). After four times of intrathecal administration of SIP30 antisense (AS) or missense (MM) ODN, rats were sacrificed and the lumbar spinal cords were dissected at six hours after the last injection. Real-time PCR amplification for SIP30 mRNA showed a significant decrease in ipsilateral spinal cord in CCI rats receiving SIP30 AS ODN compared with animals receiving MM ODN ($p<0.05$). The dotted line indicates mRNA level in sham CCI animals. (B) Western blot for SIP30 protein indicated a significant decrease in ipsilateral spinal cord in CCI rats receiving SIP30 AS ODN compared with animals receiving MM ODN or NS. Top panel, representative Western blots of SIP30 protein. β-Actin was used as the internal control. Bottom panel, quantitative results of SIP30 protein. The dotted line indicates protein level in sham ones. significant difference from NS or MM ($p<0.05$). Abbreviation: NS, normal saline; AS ODN, antisense oligodeoxynucleotides; MM, missense; day (0-3), rats were injected intrathecally with AS, MM, or NS from day 0 (6 hrs before CCI operation) to day 3 post-CCI; day (4-7), rats were injected intrathecally with AS, MM, or NS from day 4 to day 7 post-CCI. (C) Real-time PCR amplification for SNAP25 mRNA showed a significant increase in ipsilateral spinal cord after CCI operation. $p<0.05$ vs. sham group. Intrathecal injection of SIP30 AS ODN every 24 hours for 4 times caused a trend to decrease in SNAP25 mRNA in ipsilateral spinal cord of CCI rats, although that did not reach statistical significance. (D) Real-time PCR amplification for PSD95 mRNA showed a significant increase in ipsilateral spinal cord after CCI operation. $p<0.05$ vs. sham group. Intrathecal injection of SIP30 AS ODN every 24 hours for 4 times did not affect PSD95 mRNA levels.
Figure 6B:
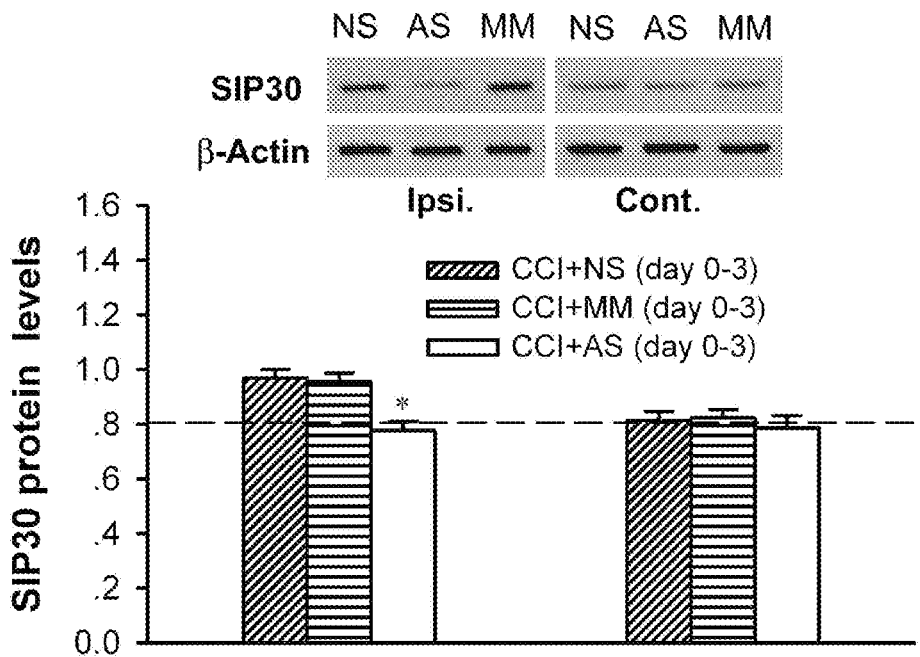
Figure 6C:
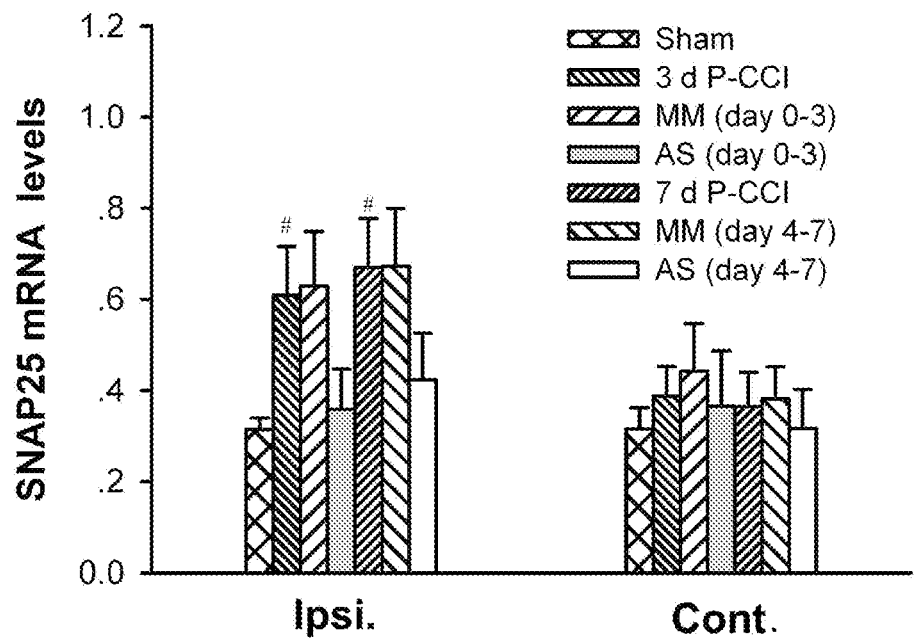
Figure 6D:
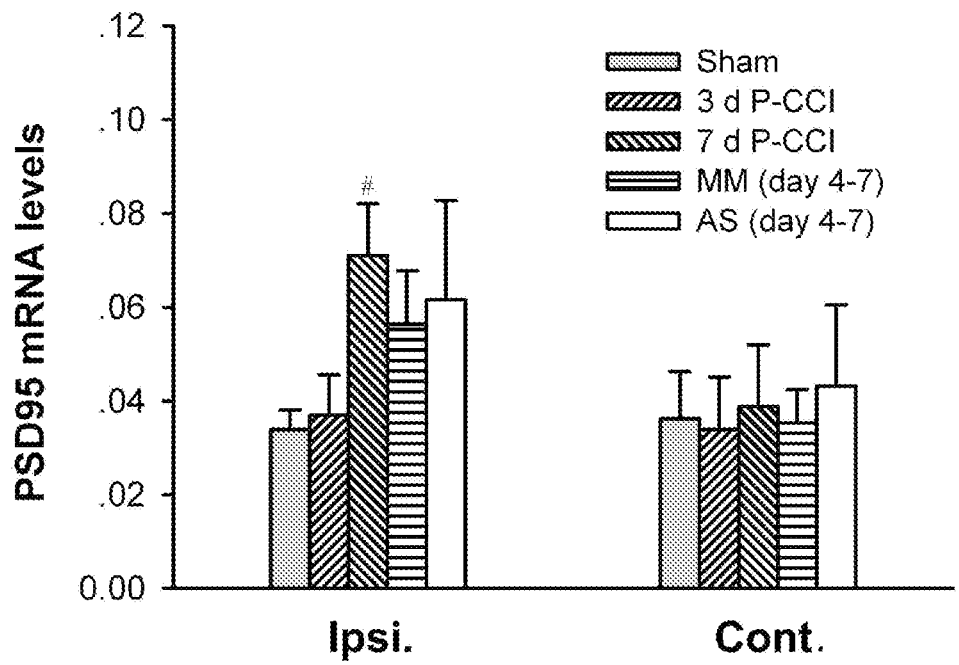

SIP30 co-localizes with markers for small-diameter neurons—To evaluate SIP30 expression pattern in various CNS and peripheral tissues, Northern blot analysis was carried out, showing that SIP30 is mainly expressed in the CNS (FIG. 3). These results corroborate with the earlier report (Lee et al., 2002).

Next, the expression of SIP30 in the DRG was examined. Small-diameter DRG neurons are primarily nociceptors. They can be divided neurochemically into two populations: isolectinB4 (IB4)-positive nonpeptidergic neurons, and IB4-negative peptidergic neurons. The IB4 negative neurons express TrkA receptors for nerve growth factor (NGF), depend on NGF for survival, and contain neuropeptides including calcitonin gene-related peptide and substance P. The IB4 positive neuronal population expresses receptors for glial-derived neurotrophic factor (GDNF), neurturin, or artemin. The Isolectin B4-positive and -negative nociceptors are functionally distinct (Stucky and Lewin, 1999). It has been hypothesized that IB4-negative neurons specifically contribute to inflammatory pain and that IB4-positive neurons contribute to neuropathic pain (Mantyh and Hunt, 1998; Snider and McMahon, 1998; Breese et al., 2005).

SIP30 expression was examined together with IB4 and CGRP in normal adult rats DRG (L4-L5). SIP30 is expressed across small to medium diameter DRG neurons (FIG. 3). SIP30 displayed an overlapping pattern with IB4 and CGRP in some neurons but mainly co-expressed with CGRP (FIG. 3), suggesting a peptidergic nature.

SIP30 immunoreactivity was examined in the lumbar spinal cord, where it was found to be expressed in all lumbar levels and throughout all laminae. SIP30 immunoreactivity was particularly concentrated in the superficial dorsal horn lamina I and II (FIG. 3), and showed a strong co-expression pattern with nociception-related neuropeptides CGRP and substance P (FIG. 3). In addition, SIP30 immunostaining was present in cell bodies in laminae IV-VII as well as in motor neurons in the ventral horn.

Upregulation of SIP30 in the spinal cord following CCI— The change in SIP30 mRNA was measured by quantitative real-time PCR, in both spinal cord and DRG of either CCI or sham-operated rats. The expression levels of two other genes were used as reference points to normalize the amount of total RNA amount in each sample. The expression of β-actin and glyceraldehydes-3-phosphate dehydrogenase (GAPDH) among the intact and CCI rats' spinal cord and DRG using quantitative real-time PCR analysis were first examined. The β-actin and GAPDH genes expression of the CCI rats was normalized to those of intact rats. It was shown that β-actin expressed more consistently than GAPDH in the spinal cord and DRG (data not shown). Thus, β-actin was chosen as a reference in the present study. Both on day 3 and 7 post-CCI, a statistically significant ($p<0.05$) increase of SIP30 mRNA in the ipsilateral, but not contralateral spinal cord was observed in CCI rats compared to sham or intact rats (FIG. 4).

However, in the DRG, SIP30 mRNA expression was not modified by CCI procedure. There was no difference between the ipsilateral and contralateral DRG in either sham or CCI rats (FIG. 4).

The upregulation of SIP30 protein was also demonstrated by western blotting analysis of the spinal cord from CCI rats. Increased signal for SIP30 was observed in ipsilateral lumbar spinal cord compared with the contralateral side of CCI rats and both side of sham-CCI animals (FIG. 4). Similar to the expression of SIP30 mRNA in the DRG from CCI and Sham rats, no significant changes in western blotting signal for SIP30 were found on both sides of the DRG following CCI (FIG. 4).

Spinal cord immunostaining indicated that SIP30 protein level was elevated in the ipsilateral side of spinal cord dorsal horn 3 and 7 days after CCI (FIG. 4).

SIP30 localization in CCI spinal cord was examined, showing colocalization with NeuN, a neuronal marker, in the spinal dorsal horn, 3 days after CCI (FIG. 4). SIP30 did not show overlap staining with either GFAP or OX-42 (FIG. 4).

These results indicate that during CCI, SIP30 levels were upregulated in the ipsilateral side of the spinal cord, suggesting a potential functional association between SIP30 levels and neuropathic pain.

SIP30 is involved in the development and maintenance of neuropathic pain. —Intrathecal administration of SIP30 AS (50 mg/10 ul, once a day for 4 days) starting on day 0 (6 hrs before CCI), produced a partial inhibition in the development of mechanical allodynia and thermal hyperalgesia by day 4 of SIP30 AS administration (FIG. 5). Two-way ANOVA showed a statistically significant difference between the antisense group and NS group ($p<0.05$). Two days after cessation of AS administration (post-CCI day 5), the AS group showed mechanical allodynia similar to the NS group (FIG. 5). On post-CCI day 7, thermal hyperalgesia appeared with similar paw withdrawal latencies to that of NS group (FIG. 5). Administration of MM had no effect on the development of mechanical allodynia and thermal hyperalgesia. Contralateral paw withdrawal thresholds and latencies were not affected by AS, MM, and NS treatment (FIG. 5).

To further verify SIP30-specific effect, the functional consequences of "knock-down" of SIP30 protein by a second SIP30 AS ODN (SEQ. ID No. 133) (AS II: 5'-GGC AAT CCT ACA GGT ICC AG-3') directed towards nucleotides 143-162 of the coding region of the SIP30 gene, was examined. This AS II also produced an attenuation of CCI-induced mechanical allodynia and thermal hyperalgesia (FIG. 5). Two-way ANOVA showed a statistically significant difference between the antisense group and universal control (random ODN, 5-ACG TAA GCA ACG CTC AGC TA-3' (SEQ. ID No. 264)).

By the 3rd day after CCI, animals developed both mechanical allodynia and thermal hyperalgesia. After this point of established neuropathic pain, 4th day of treatment with SIP30 AS resulted in an increase in paw withdrawal thresholds and latencies on the ipsilateral side to the CCI by the end of AS ODN treatment.

Two-way ANOVA showed a statistically significant difference between the antisense group and NS, or MM group on day 7 and 9 post-CCI ($p<0.05$, FIG. 5). Four days after AS withdrawal, mechanical allodynia and thermal hyperalgesia reappeared. Neither MM ODN nor NS altered paw withdrawal responses to mechanical and thermal stimuli in CCI rats. There was no effect of NS, AS and MM ODN treatment on contra-lateral hindpaw during and post treatment period (FIG. 5).

Treatment with SIP30 AS ODN (50 mg/10 ul, once a day for 4 days) had no detectable effect on the responses of naïve rats to Von Frey and thermal stimuli in both hindpaws ($p>0.05$, FIG. 5). Additionally, to rule out the possibility that intrathecal SIP30 AS ODN may produce non-specific motor deficiencies, locomotor activities were measured in naïve rats receiving SIP30 AS, and no abnormal behavior or motor deficiencies were observed during treatment with SIP30 AS ODN (data not shown).

Taken together, these findings showed that inhibition of upregulated SIP30 levels in the spinal cord resulted in attenuation of neuropathic pain behaviors both during the development process and the maintenance phase of neuropathic pain, suggesting a cause-effect relation between SIP30 up-regulation and the phenomenon of neuropathic pain.

Anti-SIP30 oligonucleotide knock-down inhibits both SIP30 and SNAP25 expression in the spinal cord—Considering the CCI procedure failed to affect the expression of SIP30 in the DRG at either mRNA or protein level, the following observations were focused only on the spinal cord. In order to verify whether intrathecal administration of SIP30 AS ODN indeed results in knockdown of SIP30 by disrupting the translation of SIP30 mRNA, the effect of SIP30 AS ODN on SIP30 mRNA and protein expression was assessed. SIP30 AS (50 ug/10 ul) and MM ODN (50 ug/10 ul) were injected intrathecally. The lumbar enlargement segments of the spinal cord were harvested at 6 hrs after the last injection. Quantitative PCR showed that SIP30 AS ODN significantly decreased SIP30 mRNA in the ipsilateral spinal cord compared with that by SIP30 mM ODN administration, for either day 0-3 or day 4-7 (FIG. 6). Moreover, western blotting showed that the SIP30 AS, but not MM ODN, markedly reduced the expression of SIP30 in the ipsilateral spinal cord to CCI after 3 days repeated intrathecal administration (FIG. 6), further substantiating the AS mediated "knockdown" of the SIP30 protein.

To assess the selective effect of SIP30 AS, we also examined two related synaptic proteins that are expressed in the spinal cord, synaptosome-associated proteins of 25 kDa (SNAP25), and postsynaptic density protein-95 (PSD95).

As shown in FIG. 6 SNAP25 mRNA exhibited significant up-regulation in the ipsilateral spinal cord on both day 3 and 7 post-CCI. PSD95 mRNA in the spinal cord, on the other hand, had no detectable change until day 7 post-CCI. Neither SIP30 AS nor MM ODN blocked the upregulation of PSD95 mRNA in the ipsilateral spinal cord on day 7 after CCI (FIG. 6).

Example 2

Role of SIP30 in Intensifying Pain Sensitivity

Under isoflurane anesthesia, CD-1 mice were subjected to intrathecal administration of SIP30 and control reagents, in the form of plasmid DNA. Either plasmid containing SIP30 sequence or empty plasmid were used, together with a lipid transfection reagent. The control group of mice (n=6) received 2.0 ug empty plasmid DNA per mouse. For SIP30-containing plasmid, group A mice (n=5) received 2.0 ug SIP30 plasmid DNA per mouse, and group B mice (n=5) received 5.25 ug SIP30 plasmid DNA per mouse. The mice were tested for paw withdraw threshold via Von Frey filament over the next 24 days.

Figure 7:
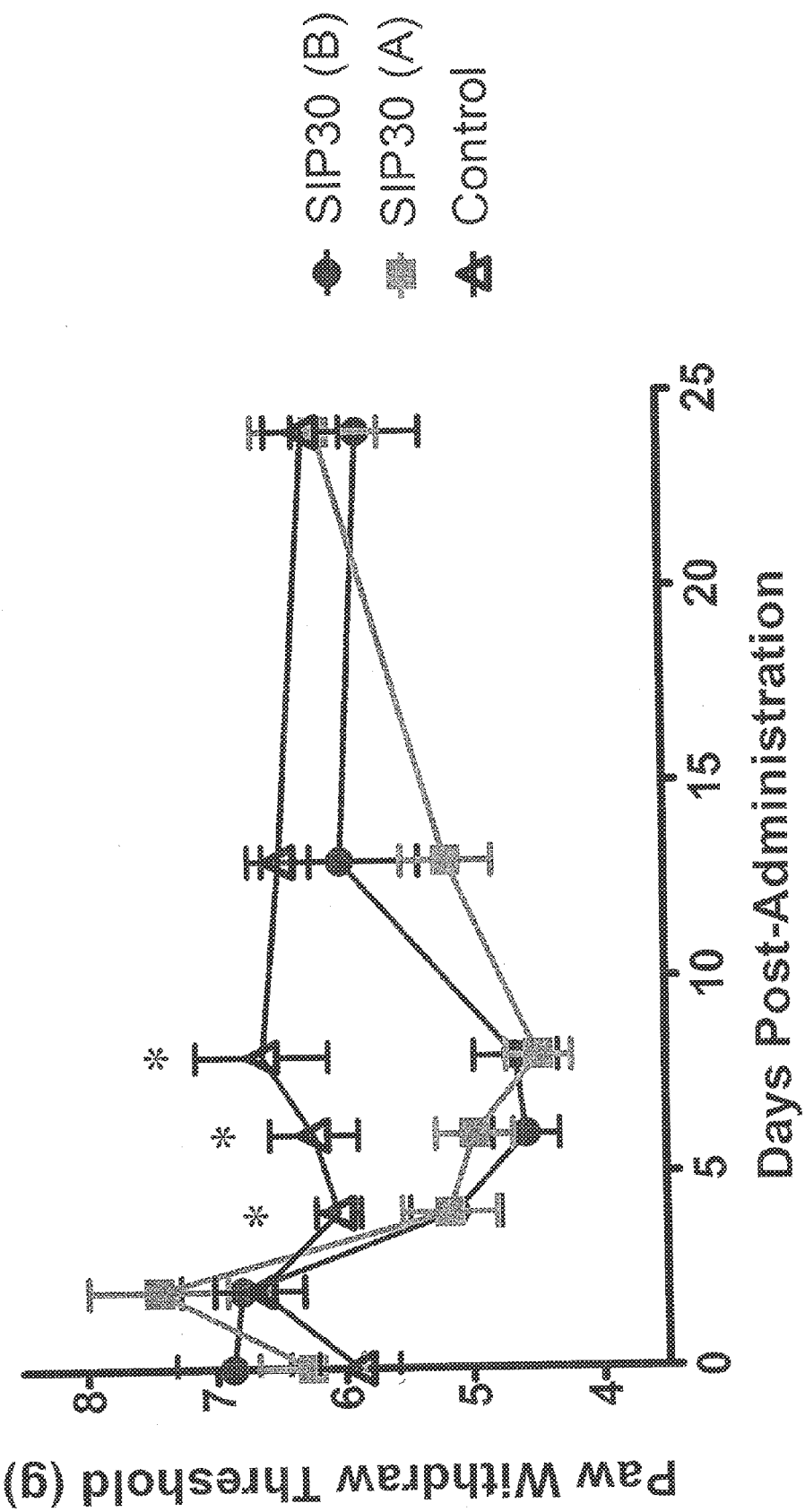
FIG. 7. Mice in both SIP30 groups A and B provide significant change in Paw Withdraw Threshold from control group of mice at testing days 4, 6, and 8 (*, $p<0.05$ significant difference compared to control).

FIG. 7 depicts the outcome of the experiment. Mice in both SIP30 groups A and B showed significant change in Paw Withdraw Threshold from control group of mice at testing days 4, 6, and 8 (*, p<0.05 significant difference compared to control). Measurements included both legs from each mouse. By day 24, paw withdraw threshold had returned to normal levels. Those of ordinary skill in the art in possession of the present invention would appreciate the direct role of SIP30 in aggravating the neuropathic pain. The present findings provide ample guidance as to the duration and degree of SIP30 antagonism that is required to provide a therapeutic regimen.

Although the invention herein has been described with reference to particular embodiments, it is to be understood that these embodiments are merely illustrative of the principles and applications of the present invention. It is therefore to be understood that numerous modifications may be made to the illustrative embodiments and that other arrangements may be devised without departing from the spirit and scope of the present invention as defined by the following claims.

SEQUENCE LISTING (264 sequences)

SEQ ID NO: 1 - DNA, 1660 bp, Homo sapiens
attgtgggaaggcagctgaactcggcgcctggaaagatggaggcagcggagacagaggcggaagctgcagccctagaggtcctggctgaggtggcaggcatcttggaacctgtaggcctgcaggaggaggcagaactgccagccaagatcctggttgagtttgtggtggactctcagaagaaagacaagctgctctgcagccagcttcaggtagcggatttcctgcagaacatcctggctcaggaggacactgctaagggtctcgaccccttggcttctgaagacacgagccgacagaaggcaattgcagctaaggaacaatggaaagagctgaaggccacctacagggagcacgtagaggccatcaaaattggcctcaccaaggccctgactcagatggaggaagcccagaggaaacggacacaactccgggaagcctttgagcagctccaggccaagaaacaaatggccatggagaaacgcagagcagtccagaaccagtggcagctacaacaggagaagcatctgcagcatctggcggaggtttctgcagaggtgagggagcgtaagacagggactcagcaggagcttgacggggtgtttcagaaacttggaaacctgaagcagcaggcagaacaggagcgggacaagctgcagaggtatcagaccttcctccagcttctgtataccctgcagggtaagctgttgttccctgaggctgaggctgaggcagagaatcttccagatgataaaccccagcagccgactcgaccccaggagcagagtacaggagacaccatggggagagaccctggtgtgtccttcaaggctgttggtctacaacctgctggagatgtaaatttgccatgacttcctggaggacagcagcatggagaaagatcctagaaaaggcctctgacttccctcacctcccaaccatcattacaggaaagactgtgaactcctgagttcagcttgatttctgactacatcccagcaagctctggcatctgtggattaaaatccctggatctctctcagttgtgtatttgttcatcttcatatgctggcaggaacaactattaatacagatactcagaagccaataacatgacaggagctgggactggtttgaacacagggtgtgcagatggggagggggtactggccttgggcctcctatgatgcagacatggtgaatttaattcaaggaggaggagaatgttttaggcaggtggttatatgtgggaagataattttattcatggatccaaatgtttgttgagtcctttctttgtgctaaggttcttgcggtgaaccagaattataacagtgagctcatctgactgttttaggatgtacagcctagtgttaacattcttggtatctttttgtgccttatctaaaacatttctcgatcactggtttcagatgttcatttattatattcttttcaaagattcagagattggcttttgtcatccactattgtatgttttgtttcattgacctctagtgataccttgatctttcccactttctgttttcggattggagaagatgtaccttttttgtcaactcttacttttatcagatgatcaactcacgtatttggatctttatttgttttctcaaataaatatttaaggttaaaaaaaaa

SEQ ID NO: 2 - DNA, 1660 bp, Homo sapiens
gattgtgggaaggcagctgaactcggcgcctggaaagatggaggcagcggagacagaggcggaagctgcagccctagaggtcctggctgaggtggcaggcatcttggaacctgtaggcctgcaggaggaggcagaactgccagccaagatcctggttgagtttgtggtggactctcagaagaaagacaagctgctctgcagccagcttcaggtagcggatttcctgcagaacatcctggctcaggaggacactgctaagggtctcgaccccttggcttctgaagacacgagccgacagaaggcaattgcagctaaggaacaatggaaagagctgaaggccacctacagggagcacgtagaggccatcaaaattggcctcaccaaggccctgactcagatggaggaagcccagaggaaacggacacaactccgggaagcctttgagcagctccaggccaagaaacaaatggccatggagaaacgcagagcagtccagaaccagtggcagctacaacaggagaagcatctgcagcatctggcggaggtttctgcagaggtgagggagcgtaagacagggactcagcaggagcttgacagggtgtttcagaaacttggaaacctgaagcagcaggcagaacaggagcgggacaagctgcagaggtatcagaccttcctccagcttctgtataccctgcagggtaagctgttgttccctgaggctgaggctgaggcagagaatcttccagatgataaaccccagcagccgactcgaccccaggagcagagtacaggagacaccatggggagagaccctggtgtgtccttcaaggctgttggtctacaacctgctggagatgtaaatttgccatgacttcctggaggacagcagcatggagaaagatcctagaaaaggcctctgacttccctcacctcccaaccatcattacaggaaagactgtgaactcctgagttcagcttgatttctgactacatcccagcaagctctggcatctgtggattaaaatccctggatctctctcagttgtgtatttgttcatcttcatatgctggcaggaacaactattaatacagatactcagaagccaataacatgacaggagctgggactggtttgaacacagggtgtgcagatggggagggggtactggccttgggcctcctatgatgcagacatggtgaatttaattcaaggaggaggagaatgttttaggcaggtggttatatgtgggaagataattttattcatggatccaaatgtttgttgagtcctttctttgtgctaaggttcttgcggtgaaccagaattataacagtgagctcatctgactgttttaggatgtacagcctagtgttaacattcttggtatctttttgtgccttatctaaaacatttctcgatcactggtttcagatgttcatttattatattcttttcaaagattcagagattggcttttgtcatccactattgtatgttttgtttcattgacctctagtgataccttgatctttcccactttctgttttcggattggagaagatgtaccttttttgtcaactcttacttttatcagatgatcaactcacgtatttggatctttatttgttttctcaaataaatatttaaggttatacattt

SEQ ID NO: 3 - DNA, 1852 bp, Homo sapiens
gattgtgggaaggcagctgaactcggcgcctggaaagatggaggcagcggagacagaggcggaagctgcagccctagaggtcctggctgaggtggcaggcatcttggaacctgtaggcctgcaggaggaggcagaactgccagccaagatcctggttgagtttgtggtggactctcagaagaaagacaagctgctctgcagccagcttcaggtagcggatttcctgcagaacatcctggctcaggaggacactgctaagggtctcgaccccttggcttctgaagacacgagccgacagaaggcaattgcagctaaggaacaatggaaagagctgaaggccacctacagggagcacgtagaggccatcaaaattggcctcaccaaggccctgactcagatggaggaagcccagaggaaacggacacaactccgggaagcctttgagcagctccaggccaagaaacaaatggccatggagaaacgcagagcagtccagaaccagtggcagctacaacaggagaagcatctgcagcatctggcggaggtttctgcagaggtgagggagcgtaagacagggactcagcaggagcttgacagggtgtttcagaaacttggaaacctgaagcagcaggcagaacaggagcgggacaagctgcagaggtatcagaccttcctccagcttctgtataccctgcagggtaagctgttgttccctgaggctgaggctgaggcagagaatcttccagatgataaaccccagcagccgactcgaccccaggagcagagtacaggagacaccatggggagagaccctggtgtgtccttcaaggctgttggtctacaacctgctggagatgtaaatttgccatgacttcctggaggacagcagcatggagaaagatcctagaaaaggtcagacccaactcaggccttggtgtccctggactgcaagtgtggaaggagggaaagcctggtttacctctctctgcatctgagctctgctacccatggagcagatggatggtgggaacaggaaagagcttatgttacacctcattcccatgcttagcccacccagagctaacccctgtcttcttccccaggcctctgacttccctcacctcccaaccatcattacaggaaagactgtgaactcctgagttcagcttgatttctgactacatcccagcaagctctggcatctgtggattaaaatccctggatctctctcagttgtgtatttgttcatcttcatatgctggcaggaacaactattaatacagatactcagaagccaataacatgacaggagctgggactggtttgaacacagggtgtgcagatggggagggggtactggccttgggcctcctatgatgcagacatggtgaatttaattcaaggaggaggagaatgttttaggcaggtggttatatgtgggaagataattttattcatggatccaaatgtttgttgagtcctttctttgtgctaaggttcttgcggtgaaccagaattataacagtgagctcatctgactgttttaggatgtacagcctagtgttaacattcttggtatctttttgtgccttatctaaaacatttctcgatcactggtttcagatgttcatttattatattcttttcaaagattcagagattggcttttgtcatccactattgtatgttttgtttcattgacctctagtgataccttgatctttcccactttctgttttcggattggagaagatgtaccttttttgtcaactcttacttttatcagatgatcaactcacgtatttggatctttatttgttttctcaaataaatatttaaggttatacattta

SEQ ID NO: 4 - DNA, 1520 bp, Homo sapiens
gattgtgggaaggcagctgaactcggcgcctggaaagatggaggcagcggagacagaggcggaagctgcagccctagaggtcctggctgaggtggcaggcatcttggaacctgtaggcctgcaggaggaggcagaactgccagccaagatcctggttgagtttgtggtggactctcagaagaaagacaagctgctctgcagccagcttcaggtagcggatttcctgcagaacatcctggctcaggaggacactgctaagggtctcgaccccttggcttctgaagacacgagccgacagaaggcaattgcagctaaggaacaatggaaagagctgaaggccacctacagggagcacgtagaggccatcaaaattggcctcaccaaggccctgactcagatggaggaagcccagaggaaacggacacaactccgggaagcctttgagcagctccaggccaagaaacaaatggccatggagaaacgcagagcagtccagaaccagtggcagctacaacaggagaagcatctgcagcatctggcggaggtttctgcagagggtaagctgttgttccctgaggctgaggctgaggcagagaatcttccagatgataaaccccagcagccgactcgaccccaggagcagagtacaggagacaccatggggagagaccctggtgtgtccttcaaggctgttggtctacaacctgctggagatgtaaatttgccatgacttcctggaggacagcagcatggagaaagatcctagaaaaggcctctgacttccctcacctcccaaccatcattacaggaaagactgtgaactcctgagttcagcttgatttctgactacatcccagcaagctctggcatctgtggattaaaatccctggatctctctcagttgtgtatttgttcatcttcatatgctggcaggaacaactattaatacagatactcagaagccaataacatgacaggagctgggactggtttgaacacagggtgtgcagatggggagggggtactggccttgggcctcctatgatgcagacatggtgaatttaattcaaggaggaggagaatgttttaggcaggtggttatatgtgggaagataattttattcatggatccaaatgtttgttgagtcctttctttgtgctaaggttcttgcggtgaaccagaattataacagtgagctcatctgactgttttaggatgtacagcctagtgttaacattcttggtatctttttgtgccttatctaaaacatttctcgatcactggtttcagatgttcatttattatattcttttcaaagattcagagattggcttttgtcatccactattgtatgttttgtttcattgacctctagtgataccttgatctttcccactttctgttttcggattggagaagatgtaccttttttgtcaactcttacttttatcagatgatcaactcacgtatttggatctttatttgttttctcaaataaatatttaaggttatacattta

SEQ ID NO: 5 - DNA, 1640 bp, Homo sapiens
cagctgaactcggcgcctggaaagatggaggcagcggagacagaggcggaagctgcagccctagaggtcctggctgaggtggcaggcatcttggaacctgtaggcctgcaggaggaggcagaactgccagccaagatcctggttgagtttgtggtggactctcagaagaaagacaagctgctctgcagccagcttcaggtagcggatttcctgcagaacatcctggctcaggaggacactgctaagggtctcgaccccttggcttctgaagacacgagccgacagaaggcaattgcagctaaggaacaatggaaagagctgaaggccacctacagggagcacgtagaggccatcaaaattggcctcaccaaggccctgactcagatggaggaagcccagaggaaacggacacaactccgggaagcctttgagcagctccaggccaagaaacaaatggccatggagaaacgcagagcagtccagaaccagtggcagctacaacaggagaagcatctgcagcatctggcggaggtttctgcagaggtgagggagcgtaagacagggactcagcaggagcttgacggggtgtttcagaaacttggaaacctgaagcagcaggcagaacaggagcgggacaagctgcagaggtatcagaccttcctccagcttctgtataccctgcagggtaagctgttgttccctgaggctgaggctgaggcagagaatcttccagatgataaaccccagcagccgactcgaccccaggagcagagtacaggagacaccatggggagagaccctggtgtgtccttcaaggctgttggtctacaacctgctggagatgtaaatttgccatgacttcctggaggacagcagcatggagaaagatcctagaaaaggcctctgacttccctcacctcccaaccatcattacaggaaagactgtgaactcctgagttcagcttgatttctgactacatcccagcaagctctggcatctgtggattaaaatccctggatctctctcagttgtgtatttgttcatcttcatatgctggcaggaacaactattaatacagatactcagaagccaataacatgacaggagctgggactggtttgaacacagggtgtgcagatggggagggggtactggccttgggcctcctatgatgcagacatggtgaatttaattcaaggaggaggagaatgttttaggcaggtggttatatgtgggaagataattttattcatggatccaaatgtttgttgagtcctttctttgtgctaaggttcttgcggtgaaccagaattataacagtgagctcatctgactgttttaggatgtacagcctagtgttaacattcttggtatctttttgtgccttatctaaaacatttctcgatcactggtttcagatgttcatttattatattcttttcaaagattcagagattggcttttgtcatccactattgtatgttttgtttcattgacctctagtgataccttgatctttcccactttctgttttcggattggagaagatgtaccttttttgtcaactcttacttttatcagatgatcaactcacgtatttggatctttatttgttttctcaaataaatatttaaggtta

SEQ ID NO: 6 - DNA, 1640 bp, Homo sapiens
ggcacgagctcggctcctggaaagatggaggcagcggagacagaggcggaagctgcagccctagaggtcctggctgaggtggcaggcatcttggaacctgtaggcctgcaggaggaggcagaactgccagccaagatcctggttgagtttgtggtggactctcagaagaaagacaagctgctctgcagccagcttcaggtagcggatttcctgcagaacatcctggctcaggaggacactgctaagggtctcgaccccttggcttctgaagacacgagccgacagaaggcaattgcagctaaggaacaatggaaagagctgaaggccacctacagggagcacgtagaggccatcaaaattggcctcaccaaggccctgactcagatggaggaagcccagaggaaacggacacaactccgggaagcctttgagcagctccaggccaagaaacaaatggccatggagaaacgcagagcagtccagaaccagtggcagctacaacaggagaagcatctgcagcatctggcggaggtttctgcagaggtgagggagcgtaagacagggactcagcaggagcttgacggggtgtttcagaaacttggaaacctgaagcagcaggcagaacaggagcgggacaagctgcagaggtatcagaccttcctccagcttctgtataccctgcagggtaagctgttgttccctgaggctgaggctgaggcagagaatcttccagatgataaaccccagcagccgactcgaccccaggagcagagtacaggagacaccatggggagagaccctggtgtgtccttcaaggctgttggtctacaacctgctggagatgtaaatttgccatgacttcctggaggacagcagcatggagaaagatcctagaaaaggcctctgacttccctcacctcccaaccatcattacaggaaagactgtgaactcctgagttcagcttgatttctgactacatcccagcaagctctggcatctgtggattaaaatccctggatctctctcagttgtgtatttgttcatcttcatatgctggcaggaacaactattaatacagatactcagaagccaataacatgacaggagctgggactggtttgaacacagggtgtgcagatggggagggggtactggccttgggcctcctatgatgcagacatggtgaatttaattcaaggaggaggagaatgttttaggcaggtggttatatgtgggaagataattttattcatggatccaaatgtttgttgagtcctttctttgtgctaaggttcttgcggtgaaccagaattataacagtgagctcatctgactgttttaggatgtacagcctagtgttaacattcttggtatctttttgtgccttatctaaaacatttctcgatcactggtttcagatgttcatttattatattcttttcaaagattcagagattggcttttgtcatccactattgtatgttttgtttcattgacctctagtgataccttgatctttcccactttctgttttcggattggagaagatgtaccttttttgtcaactcttacttttatcagatgatcaactcacgtatttggatctttatttgttttctcaaataaatatttaaggtta

SEQ ID NO: 7 - DNA, 2430 bp, Chimpanzee type C endogenous retrovirus
gggattgtgggaaggcagctgaactcggcgcctggaaagatggaggcagcggagacagaggcggaagctgcagccctagaggtcctggctgaggtggcaggcatcctggaacctgtaggcctgcaggaggaggcagaactgccagccaagatcctggttgagtttgtggtggactctcagaagaaagacaagctgctctgcagccagcttcaggtagcggatttcctgcagaacatcctggctcaggaggacactgctaagggtctcgaccccttggcttctgaagacacgagccggcagaaggcaattgcagctaaggaacaatggaaagagctgaaggccacctacagggagcacgtagaggccatcaaaattggcctcaccaaggccctgactcagatggaggaagcccagaggaaacggacacaactccaggaagcctttgagcagctccaggccaagaaacaaatggccatggagaaacgcagagcagtccagaaccagtggcagctacaacaggagaagcatctgcagcatctggcggaggtttctgcagagggtaagctgttgttccctgaggctgaggctgaggcagagaatcttccagatgataaaccccagcagccgactcgaccccaggagcagagtacaggagacaccatggggagagaccctggtgtgtccttcaaggctgtcggtctacaacctgctggagatgcaaatttgccatgacttcctggaggacagcagcatggagaaagatcctagaaaaggtcagacccaactcaggccttggtgtccctggactgcaagtgtggaaggagggaaagcctggtttacctctctctgcatctgagctctgctacccatggagcagacggatggtgggaacaggaaagagcttatgttacacctcattcccatgcttagcccacccagagctaacccctgtcttcttccccaggcctctgacttccctcacctcccaaccatcattacaggaaagactgtgaactcctgagttcagcttgatttctgactacatcccagcaagctctggcatctgtggattaaaatccctggatctctctcagttgtgtatttgttcatattcatatgctggcaggaacaactattaatacagatactcagaagccaataacatgacaggagctgggactggtttgaacacagggtgtgcagatggggagggggtactggccttgggcctcaggggttgcttccccctatgatgcagacatggtgaatttaattcaaggaggaggagaatgttttaggcaggtggttatatgtgggaagataatttattcactaatccaaattgtattcatggatccaaatgtttgttgagtcctttctttgtgctaaggttcttgcggtgaaccagaattataacagtgagctcatctgactgttttaggatgtacagcctagtgttaacattcttggtatctttttgtgccttatctaaaacatttctcgatcactggtttcagatgttcatgtattatattcttttcaaagattcagagattggcttttgtcatccactattgtatgttttgtttcattgacctctagtgataccttgatctttcccactttctgttttcggatggagaagatgtaccttttttgtcaactcttacttttatcagatgatcaactcatgtatttggatctttatttgttttctcaaatatttaaggttatacatttcttctgacttcctttattttcacaatcattcaattcatagcatttcctatattctgttataattatttcattgattcataaatttctttgaaaaataatttggtcttctattgattgtgagaagataatctaagtttaatttggtcagagaatatcatctatttaacaaactttgtaatttggtgagtgaattatcttttttactgataaagagtgatgtcatcttttttaatgtttcacataggtttggaaagaatgcattttagattgtgtgtagtattttctattagattatgtttgcaatttttgtttcaatttatatcttatatacttaattttttgttgtctatcacctgagaggtgtgttcaaatctccaactatgatagtggatttgttcatttgtctttatagttccattttcttacatactttgcagctactttattaaggtatatgtaaatttacatttatatttttcttctgaactgaactctttgtgtggtagcctgcttcatctataggctaatgtgtttaaccttgaaaactaatagttttaatagtaatataactttgtcacttcttttggttaccctttgcttgacatcctttctcttgaatttccattcttttttagtttcaacctttctttatatttaccacttgtatacagcatttaaagggttatttat

SEQ ID NO: 8 - DNA, 2350 bp, Chimpanzee type C endogenous retrovirus
gggattgtgggaaggcagctgaactcggcgcctggaaagatggaggcagcggagacagaggcggaagctgcagccctagaggtcctggctgaggtggcaggcatcctggaacctgtaggcctgcaggaggaggcagaactgccagccaagatcctggttgagtttgtggtggactctcagaagaaagacaagctgctctgcagccagcttcaggtagcggatttcctgcagaacatcctggctcaggaggacactgctaagggtctcgaccccttggcttctgaagacacgagccggcagaaggcaattgcagctaaggaacaatggaaagagctgaaggccacctacagggagcacgtagaggccatcaaaattggcctcaccaaggccctgactcagatggaggaagcccagaggaaacggacacaactccaggaagcctttgagcagctccaggccaagaaacaaatggccatggagaaacgcagagcagtccagaaccagtggcagctacaacaggagaagcatctgcagcatctggcggaggtttctgcagaggtgagggagcgtaagacagggactcagcaggcgcttgagggggtgtttcagaaacttggaaacctgaagcagcaggcagaacaggagcgggacaagctgcagagggtaagctgttgttccctgaggctgaggctgaggcagagaatcttccagatgataaaccccagcagccgactcgaccccaggagcagagtacaggagacaccatggggagagaccctggtgtgtccttcaaggctgtcggtctacaacctgctggagatgcaaatttgccatgacttcctggaggacagcagcatggagaaagatcctagaaaaggcctctgacttccctcacctcccaaccatcattacaggaaagactgtgaactcctgagttcagcttgatttctgactacatcccagcaagctctggcatctgtggattaaaatccctggatctctctcagttgtgtatttgttcatattcatatgctggcaggaacaactattaatacagatactcagaagccaataacatgacaggagctgggactggtttgaacacagggtgtgcagatggggagggggtactggccttgggcctcaggggttgcttccccctatgatgcagacatggtgaatttaattcaaggaggaggagaatgttttaggcaggtggttatatgtgggaagataatttattcactaatccaaattgtattcatggatccaaatgtttgttgagtcctttctttgtgctaaggttcttgcggtgaaccagaattataacagtgagctcatctgactgttttaggatgtacagcctagtgttaacattcttggtatctttttgtgccttatctaaaacatttctcgatcactggtttcagatgttcatgtattatattcttttcaaagattcagagattggcttttgtcatccactattgtatgttttgtttcattgacctctagtgataccttgatctttcccactttctgttttcggatggagaagatgtaccttttttgtcaactcttacttttatcagatgatcaactcatgtatttggatctttatttgttttctcaaatatttaaggttatacatttcttctgacttcctttattttcacaatcattcaattcatagcatttcctatattctgttataattatttcattgattcataaatttctttgaaaaataatttggtcttctattgattgtgagaagataatctaagtttaatttggtcagagaatatcatctatttaacaaactttgtaatttggtgagtgaattatcttttttactgataaagagtgatgtcatcttttttaatgtttcacataggtttggaaagaatgcattttagattgtgtgtagtattttctattagattatgtttgcaatttttgtttcaatttatatcttatatacttaattttttgttgtctatcacctgagaggtgtgttcaaatctccaactatgatagtggatttgttcatttgtctttatagttccattttcttacatactttgcagctactttattaaggtatatgtaaatttacatttatatttttcttctgaactgaactctttgtgtggtagcctgcttcatctataggctaatgtgtttaaccttgaaaactaatagttttaatagtaatataactttgtcacttcttttggttaccctttgcttgacatcctttctcttgaatttccattcttttttagtttcaacctttctttatatttaccacttgtatacagcatttaaagggttatttataaaaaaa

SEQ ID NO: 9 - DNA, 2580 bp, Chimpanzee type C endogenous retrovirus
gggattgtgggaaggcagctgaactcggcgcctggaaagatggaggcagcggagacagaggcggaagctgcagccctagaggtcctggctgaggtggcaggcatcctggaacctgtaggcctgcaggaggaggcagaactgccagccaagatcctggttgagtttgtggtggactctcagaagaaagacaagctgctctgcagccagcttcaggtagcggatttcctgcagaacatcctggctcaggaggacactgctaagggtctcgaccccttggcttctgaagacacgagccggcagaaggcaattgcagctaaggaacaatggaaagagctgaaggccacctacagggagcacgtagaggccatcaaaattggcctcaccaaggccctgactcagatggaggaagcccagaggaaacggacacaactccaggaagcctttgagcagctccaggccaagaaacaaatggccatggagaaacgcagagcagtccagaaccagtggcagctacaacaggagaagcatctgcagcatctggcggaggtttctgcagaggtgagggagcgtaagacagggactcagcaggcgcttgagggggtgtttcagaaacttggaaacctgaagcagcaggcagaacaggagcgggacaagctgcagaggtatcagaccttcctccagcttctgtataccctgcagggtaagctgttgttccctgaggctgaggctgaggcagagaatcttccagatgataaaccccagcagccgactcgaccccaggagcagagtacaggagacaccatggggagagaccctggtgtgtccttcaaggctgtcggtctacaacctgctggagatgcaaatttgccatgacttcctggaggacagcagcatggagaaagatcctagaaaaggtcagacccaactcaggccttggtgtccctggactgcaagtgtggaaggagggaaagcctggtttacctctctctgcatctgagctctgctacccatggagcagacggatggtgggaacaggaaagagcttatgttacacctcattcccatgcttagcccacccagagctaacccctgtcttcttccccaggcctctgacttccctcacctcccaaccatcattacaggaaagactgtgaactcctgagttcagcttgatttctgactacatcccagcaagctctggcatctgtggattaaaatccctggatctctctcagttgtgtatttgttcatattcatatgctggcaggaacaactattaatacagatactcagaagccaataacatgacaggagctgggactggtttgaacacagggtgtgcagatggggagggggtactggccttgggcctcaggggttgcttccccctatgatgcagacatggtgaatttaattcaaggaggaggagaatgttttaggcaggtggttatatgtgggaagataatttattcactaatccaaattgtattcatggatccaaatgtttgttgagtcctttctttgtgctaaggttcttgcggtgaaccagaattataacagtgagctcatctgactgttttaggatgtacagcctagtgttaacattcttggtatctttttgtgccttatctaaaacatttctcgatcactggtttcagatgttcatgtattatattcttttcaaagattcagagattggcttttgtcatccactattgtatgttttgtttcattgacctctagtgataccttgatctttcccactttctgttttcggatggagaagatgtaccttttttgtcaactcttacttttatcagatgatcaactcatgtatttggatctttatttgttttctcaaatatttaaggttatacatttcttctgacttcctttattttcacaatcattcaattcatagcatttcctatattctgttataattatttcattgattcataaatttctttgaaaaataatttggtcttctattgattgtgagaagataatctaagtttaatttggtcagagaatatcatctatttaacaaactttgtaatttggtgagtgaattatcttttttactgataaagagtgatgtcatcttttttaatgtttcacataggtttggaaagaatgcattttagattgtgtgtagtattttctattagattatgtttgcaatttttgtttcaatttatatcttatatacttaattttttgttgtctatcacctgagaggtgtgttcaaatctccaactatgatagtggatttgttcatttgtctttatagttccattttcttacatactttgcagctactttattaaggtatatgtaaatttacatttatatttttcttctgaactgaactctttgtgtggtagcctgcttcatctataggctaatgtgtttaaccttgaaaactaatagttttaatagtaatataactttgtcacttcttttggttaccctttgcttgacatcctttctcttgaatttccattcttttttagtttcaacctttctttatatttaccacttgtatacagcatttaaagggttatttataaaaaaaaa

SEQ ID NO: 10 - DNA, 1770 bp, Rattus norvegicus
ggcgtggtgggcgtcagaaccatggcggacgcggagaaaaacgctgttgcggagaaaaacgctgttgcggaggaaaacgccgttgcggaggaaaacgccgttgcggataaaaacgcaacgaaagaggttctggctgaggcagcaagcgttctggaacctgtaggattgccggaagaagcagagctgcctgccaagatcatggaggaatttatgaggaactctcggaagaaagacaagctgctctgtagccagcttcaagtagtgaacttcttacagacttttctggcccaggaggataatactgaccagaacccagatgctctggcttctgaagatacaagtcgacaaaaggcaactgaaactaaggagcagtggaaggagctgaaggcaacatacatggatcatgtggacgtcatcaaatgtgccctgtctgaggccttgccccaggttaaagaggcacacaggaagtacaccgagcttcagaaggcttttgagcaactcgaggctaagaagcgagtccttgaggagaaactgcagttagctcagaagcagtgggtgctgcagcagaagcgtttgcagaatctgacaaagatttctgctgaggtcaagagacgccggaagagagctctggagaagcttgatggttctcaccaggaacttgaaaccttgaagcagcaagcaggacaggagcaggagaagctgcagaggaaccagagctacctccagctgctgtgctccctgcagaataagctggtcatctctgagtccaaggccgacgacaaagatgtcaaagggcccgcccttccacccaagtctccgtaaagatgaaagcgagaacgagactgcgctccagctgtgctgcttgggctgagaccagagtggttccttcgctgttgtatccctaggcctaggcctgtagccttgtacaatcttccaagcggactcagtttggcatctcttggcttctcagtgaattgttctgtttcatttcttaccatatattctggcttgttctgtcttcacctgggtccaacctgctgtttctgtaaaattgtgccagtgaaattgtcacgtgcatgcacgcaggcacacaggcacgcatgccacaaccacccttttctctcgctgatcttcagtagtctctcctctggccctctctctctctgtcttctctcccgaccagatgtgaaagtaactttatgcacccgatgtaattgttgcctcggaggctcattgatgaataagctcaccctgtgtagttcttgctaaactctggctggctggttcaactcagctcttctggttcaaacccgtctccaaactgactgattgaaacaggcctctcttggcttggaaagtctgctctgaactccagaactgaacggtactgactgcactgactcgactgaacgaaactgcaccgagttgattgactccttctccctttactgctcttaagtaccctctcttccctgtgctgtcctcctgagtcatgctgccaaatctttctctgattcatcacttcgcccctcaattaaactggcaatttcaaacgtggcacttagcatttcagttgtagtcacttaatactgcattcagaacttgagtctattgaatccataatgtgaaaccatgtcttcgtgactgtgacctcactactcagtattgtgtaaaagttttaggaactctccaagtaagcacttggtatttgctcattgatagaacagaaaaatgctgtgtagataataaataaacacggctataagatta

SEQ ID NO: 11 - DNA, 1765 bp, Rattus norvegicus
gggggtcagaaccatggcggacgcggagaaaaacgctgttgcggagaaaaacgctgttgcggaggaaaacgccgttgcggaggaaaacgccgttgcggataaaaacgcaacgaaagaggttctggctgaggcagcaagcgttctggaacctgtaggattgccggaagaagcagagctgcctgccaagatcatggaggaatttatgaggaactctcggaagaaagacaagctgctctgtagccagcttcaagtagtgaacttcttacagacttttctggcccaggaggataatactgaccagaacccagatgctctggcttctgaagatacaagtcgacaaaaggcaactgaaactaaggagcagtggaaggagctgaaggcaacatacatggatcatgtggacgtcatcaaatgtgccctgtctgaggccttgccccaggttaaagaggcacacaggaagtacaccgagcttcagaaggcttttgagcaactcgaggctaagaagcgagtccttgaggagaaactgcagttagctcagaagcagtgggtgctgcagcagaagcgtttgcagaatctgacaaagatttctgctgaggtcaagagacgccggaagagagctctggagaagcttgatggttctcaccaggaacttgaaaccttgaagcagcaagcaggacaggagcaggagaagctgcagaggaaccagagctacctccagctgctgtgctccctgcagaataagctggtcatctctgagtccaaggccgacgacaaagatgtcaaagggcccgcccttccacccaagtctccgtaaagatgaaagcgagaagagagctgcgctccagctgtgctgcttgggctgagaccagagtggttccttcgctgttgtatccctaggcctaggcctgtagccttgtacaatcttccaagcggactcagtttggcatctcttggcttctcagtgaattgttctgtttcatttcttaccatatattctggcttgttctgtcttcacctgggtccaacttgctgtttctgtaaaattgtgccagtgaaattgtcacgtgcatgcacgcaggcacacaggcacgcatgccacaaccacccttttctctcgctgatcttcagtagtctctcctctggccctctctctctctgtcttctctcccgaccagatgtgaaagtaactttatgcacccgatgtaattgttgcctcggaggctcattgatgaataagctcaccctgtgtagttcttgctaaactctggctggctggttcaactcagctcttctggttcaaacccgtctccaaactgactgattgaaacaggcctctcttggcttggaaagtctgctctgaactccagaactgaacggtactgactgcactgactcgactgaacgcaactgcaccgagttgattgactccttctccctttactgctcttaagtaccctctcttccctgtgctgtcctcctgagtcatgctgccaaatctttctctgattcatcacttcgcccctcaattagactggcaatttcaaacgtggcacttagcatttcagttgtagtcacttaatactgcattcagaacttgagtctattgaatccataatgtgaaaccatgtcttcgtgactgtgacctcactactcagtattgtgtaaaagttttaggaactctccaagtaagcacttggtatttgctcattgatagaacagaaaaatgctgtgtagataataaataaacacggctataagatcaaaa

SEQ ID NO: 12 - DNA, 1496 bp, Rattus norvegicus
  misc_feature (893)..(893): n is a, c, g, or t
accatggcggacgcggagaaaaacgctgttgcggagaaaaacgctgttgcggaggaaaacgccgttgcggaggaaaacgccgttgcggataaaaacgcaacgaaagaggttctggctgaggcagcaagcgttctggaacctgtaggattgccggaagaagcagagctgcctgccaagatcatggaggaatttatgaggaactctcggaagaaagacaagctgctctgtagccagcttcaagtagtgaacttcttacagacttttctggcccaggaggataatactgaccagaacccagatgctctggcttctgaagatacaagtcgacaaaaggcaactgaaactaaggagcagtggaaggagctgaaggcaacatacatggatcatgtggacgtcatcaaatgtgccctgtctgaggccttgccccaggttaaagaggcacacaggaagtacaccgagcttcagaaggcttttgagcaactcgaggctaagaagcgagtccttgaggagaaactgcagttagctcagaagcagtgggtgctgcagcagaagcgtttgcagaatctgacaaagatttctgctgaggtcaagagacgccggaagagagctctggagaagcttgatggttctcaccaggaacttgaaaccttgaagcagcaagcaggacaggagcaggagaagctgcagaggaaccagagctacctccagctgctgtgctccctgcagaataagctggtcatctctgagtccaaggccgacgacaaagatgtcaaagggcccgcccttccacccaagtctccgtaaagatgaaagcgagaagagagctgcgctccagctgtgctgcttgggctgagaccagagtggttccttcgctgttgtatccctaggcctangcctgtagccttgtacaatcttccaagcggactcaggtttggcatctcttggcttctcagtgaattgttctgtttcatttcttaccatatattctggcttgttctgtcttcacctgggtccaacttgctgtttctgtaaaattgtgccagtgaaattgtcacgtgcatgcacgcaggcacacaggcacgcatgccacaaccacccttttctctcgctgatcttcagtagtctctcctctggccctctctctctctgtcttctctcccgaccagatgtgaaagtaactttatgcacccgatgtaattgttgcctcggaggctcattgatgaataagctcaccctgtgtagttcttgctaaactctggctggctggttcaactcagctcttctggttcaaacccgtctccaaactgactgattgaaacaggcctctcttggcttggaaagtctgctctgaactccagaactgaacggtactgactgcactgactcgactgaacgcaactgcaccgagttgattgactccttctccctttactgctcttaagtaccctctcttccctgtgctgtcctcctgagtcatgctgccaaatcctcgtgcc

SEQ ID NO: 13 - DNA, 2676 bp, Mus musculus
aaaggcgtggtgagcgacagaacgatggcggacgcggagaaaaacgctgttgcggagaaaaacaacgctgttgcgacgaaagaggttctggctgaggcagcagccattctagaacctgtaggcttgcaggaagaagcagagctgcctgccaagatcatggaggagtttatgaggaactcgcggaagaaagacaaactgctctgtagccagcttcaagtagtgaacttcttacagacttttctggctcaggaggacactgagcagagccctgatgctctggcttctgaagatgccagtcggcaaaaggcaactgaaactaaggagcagtggaaggacatgaaggccacatacatggatcacgtggatgtcataaaatgtgccctgtctgaggccttaccccaggttaaagaggctcacaggaagtacacagagcttcagaaggcttttgagcaactcgaggctaagaagcgagtccttgaggagaaacttcagctggctcagaagcagtgggtactgcaacagaagcgtttgcagaacctgacaaagatttctgcagaggtcaagaggcgccggaagagggctctggagaagcttgacggatcccatcaggaactggaaaccttgaagcagcaagcggggcaggaacaggagaagctgcagaggaaccagagctacctccagctgctgtgttcgctgcagaataagctggtcatctctgagggcaaggctgaggacaaagatgtgaaagggcgagcccttacagccaaatccaaatctccttaaagggtgaaaacattgatgggtgaaatttgcctttttgcaccgcatttatggatcatcttgaaaaagaaatgagtgcttccaaaccactcagtgaaggaggagacgaagcagctttgtaaaccgcaaagttaaatccacctactgtacagctgtcctgcaacgagagcattgagtgagaagacagcagggaaggaagaacattccaggggaagtggcagttgccatggggtggtggtggttatgaaaatgcatgagtaaaggaaaataattctgcactaagataaagcaaaaagccatagcgtgaggactgagcccagctaacaggatactggacatgagcctctctgagggagacatgtcagtgagaagctttgagtctataaactgataaggaccacattgacttctctgtacagattagaccagggatgataggtttgaaatacagatatttagaatttatggttgtattaacaagattgaaagatgactaagatctgggttaggaattgttggcagaaacgtggtaaatcttgtggttattggatagatttaggctgttttacttataccattgattggacgttaagtgtttgaactatatattgggggaattccaaagtttctttattctgaactggtaggatccagttctgtgctgacataaagaattgacagggctggaccttaaccaagaaacagcttatggtaggtgtacaattgagatttgtccaagtggtacacttgaccactgcattcatgtgtctaaggaccattgagcagacgggaattatgcagcttcactccatctagggctgagatggctaagaacacaaaagtatggtaacaactagagataggctgacacggtcagcttcaacacctgttatattatgcatgtttgtattttgaaagggacaaagaagaacactggtttggcctggaacaccttttctactgagaatgagaagtggcctgatatacttatagcttgacaagtgagatggtttgatgatgtcttcaagagctaaggagaagggactgaaagaaatttagttaagattgaaagctggttgtgaagcctgttagcagatcttcaggatggacgtagtgagatgcagcaaacctgttctttgcctgaagaacctgcaacaagactttgtggcctggattgttgacccattgcatggatatggactttctgggaaaccttagattgttggaaacatttatgggaataggaatctttcattaaatacctcaattttctttgttgttgatgttgttgttatagcacaatctaccgtattctgcctgatttaagataaagagcataaaaatagtgctagcttgtgagagttagcctgccaaggactgtgagggctagatagtgagaggttggaattgagccaagacacactgatgataaaataggtggaggagtagtgaagatagttgctgaagtatgccaggctttagttttatttagaaaaaaccataagcctttattacatttctgtttgataattatctgagcccccaaacttctcctcaaatagtctgttttaaaagtacaatttatttacttccatttatctgaagatatgtgccttccatttctaatttgaaagtgctcagagtaaatcttaggataggttagttaacatcagctgatgtctttgtctacttttgagtctgaggacaccagtgatacttaattgggtcttactctgtgctttcatttttacttgactattgttttaaagcctcatttccaaacaaagtcacaaagagccactgaaggctagatttttgtaactattaaacagtaaaaagtatgctacatgtataagatgtataaatacttatttaagaattatataagagtattct

SEQ ID NO: 14 - DNA, 1770 bp, Mus musculus
cgatggcggacgcggagaaaaacgctgttgcggagaaaaacaacgctgttgcgacgaaagaggttctggctgaggcagcagccattctagaacctgtaggcttgcaggaagaagcagagctgcctgccaagatcatggaggagtttatgaggaactcgcggaagaaagacaaactgctctgtagccagcttcaagtagtgaacttcttacagacttttctggctcaggaggacactgagcagagccctgatgctctggcttctgaagatgccagtcggcaaaaggcaactgaaactaaggagcagtggaaggacatgaaggccacatacatggatcacgtggatgtcataaaatgtgccctgtctgaggccttaccccaggttaaagaggctcacaggaagtacacagagcttcagaaggcttttgagcaactcgaggctaagaagcgagtccttgaggagaaacttcagctggctcagaagcagtgggtactgcaacagaagcgtttgcagaacctgacaaagatttctgcagaggtcaagaggcgccggaagagggctctggagaagcttgacggatcccatcaggaactggaaaccttgaagcagcaagcggggcaggaacaggagaagctgcagaggaaccagagctacctccagctgctgtgttcgctgcagaataagctggtcatctctgagggcaaggctgaggacaaagatgtgaaagggcgagcccttacagccaaatccaaatctccttaaagatgaaaggatgagaagagagccgtattcataccctgcttgggctgagaccagattggttccttcactgttgtatctctaggcctaagcctggaagtttgttgcctctgtacaatctaattctccaagctgattcaatctggcatctcttggcttttcagtgaactgttgtgttttgtctcatgctaactttgacagtatattctggcttgttctgtcttcacctgtgtctaacttgctgtccttgcaacctgtctctgtaaaagtgtaccagtgaaactcacacgcatgcatgcacgcacacaggcacgcatgccacaaccacccttttctctcgctgatcttcagtagtctctcctcttgtcctctctttttctttgtcttctctccctaccagatgtgaaagcaactttatgcgcctgctgtaattgttgtctgaggattactgcgagtaagctcaccctttgtagttactaaactggccggctggctgggtcagctccgctgtactggttcataacccggcttcaagttgactgattcaaaggggcctctcttggcttctgactgaactgctctgcttggaaagtctgatggacttcaggaacagaactgtactgactgccctgactcagctgaactcaactacaccaaattcattggttctctctgctgtactgctcttaggtagcctctctcctgtgctgtcctcctgagtcgtgctgtcaaatctctctctgattcatcactttgcccctcaattagactggcagtttcaaacacggcacttaacatttcagttgtagtcacttgatactgcattccgaacttgagtctattgaatccagaatgtgaatccatgcctttgtgactgtgacctcactctcttcagtattgtgtaaaagttttaggaactctccaagtaaatacttggtaattgctcattgatagaacagaaaaatgctgtgtagataataaataaacatataactataagattaaaaaaaaa

SEQ ID NO: 15 - DNA, 2677 bp, Mus musculus
gaaaggcgtggtgagcgacagaacgatggcggacgcggagaaaaacgctgttgcggagaaaaacaacgctgttgcgacgaaagaggttctggctgaggcagcagccattctagaacctgtaggcttgcaggaagaagcagagctgcctgccaagatcatggaggagtttatgaggaactcgcggaagaaagacaaactgctctgtagccagcttcaagtagtgaacttcttacagacttttctggctcaggaggacactgagcagagccctgatgctctggcttctgaagatgccagtcggcaaaaggcaactgaaactaaggagcagtggaaggacatgaaggccacatacatggatcacgtggatgtcataaaatgtgccctgtctgaggccttaccccaggttaaagaggctcacaggaagtacacagagcttcagaaggcttttgagcaactcgaggctaagaagcgagtccttgaggagaaacttcagctggctcagaagcagtgggtactgcaacagaagcgtttgcagaacctgacaaagatttctgcagaggtcaagaggcgccggaagagggctctggagaagcttgacggatcccatcaggaactggaaaccttgaagcagcaagcggggcaggaacaggagaagctgcagaggaaccagagctacctccagctgctgtgttcgctgcagaataagctggtcatctctgagggcaaggctgaggacaaagatgtgaaagggcgagcccttacagccaaatccaaatctccttaaagggtgaaaacattgatgggtgaaatttgcctttttgcaccgcatttatggatcatcttgaaaaagaaatgagtgcttccaaaccactcagtgaaggaggagacgaagcagctttgtaaaccgcaaagttaaatccacctactgtacagctgtcctgcaacgagagcattgagtgagaagacagcagggaaggaagaacattccaggggaagtggcagttgccatggggtggtggtggttatgaaaatgcatgagtaaaggaaaataattctgcactaagataaagcaaaaagccatagcgtgaggactgagcccagctaacaggatactggacatgagcctctctgagggagacatgtcagtgagaagctttgagtctataaactgataaggaccacattgacttctctgtacagattagaccagggatgataggtttgaaatacagatatttagaatttatggttgtattaacaagattgaaagatgactaagatctgggttaggaattgttggcagaaacgtggtaaatcttgtggttattggatagatttaggctgttttacttataccattgattggacgttaagtgtttgaactatatattgggggaattccaaagtttctttattctgaactggtaggatccagttctgtgctgacataaagaattgacagggctggaccttaaccaagaaacagcttatggtaggtgtacaattgagatttgtccaagtggtacacttgaccactgcattcatgtgtctaaggaccattgagcagacgggaattatgcagcttcactccatctagggctgagatggctaagaacacaaaagtatggtaacaactagagataggctgacacggtcagcttcaacacctgttatattatgcatgtttgtattttgaaagggacaaagaagaacactggtttggcctggaacaccttttctactgagaatgagaagtggcctgatatacttatagcttgacaagtgagatggtttgatgatgtcttcaagagctaaggagaagggactgaaagaaatttagttaagattgaaagctggttgtgaagcctgttagcagatcttcaggatggacgtagtgagatgcagcaaacctgttctttgcctgaagaacctgcaacaagactttgtggcctggattgttgacccattgcatggatatggactttctgggaaaccttagattgttggaaacatttatgggaataggaatctttcattaaatacctcaattttctttgttgttgatgttgttgttatagcacaatctaccgtattctgcctgatttaagataaagagcataaaaatagtgctagcttgtgagagttagcctgccaaggactgtgagggctagatagtgagaggttggaattgagccaagacacactgatgataaaataggtggaggagtagtgaagatagttgctgaagtatgccaggctttagttttatttagaaaaaaccataagcctttattacatttctgtttgataattatctgagcccccaaacttctcctcaaatagtctgttttaaaagtacaatttatttacttccatttatctgaagatatgtgccttccatttctaatttgaaagtgctcagagtaaatcttaggataggttagttaacatcagctgatgtctttgtctacttttgagtctgaggacaccagtgatacttaattgggtcttactctgtgctttcatttttacttgactattgttttaaagcctcatttccaaacaaagtcacaaagagccactgaaggctagatttttgtaactattaaacagtaaaaagtatgctacatgtataagatgtataaatacttatttaagaattatataagagtattct

SEQ ID NO: 16 - DNA, 1805 bp, Mus musculus
gaatccaaaggcgtggtgagcgacagaacgatggcggacgcggagaaaaacgctgttgcggagaaaaacaacgctgttgcgacgaaagaggttctggctgaggcagcagccattctagaacctgtaggcttgcaggaagaagcagagctgcctgccaagatcatggaggagtttatgaggaactcgcggaagaaagacaaactgctctgtagccagcttcaagtagtgaacttcttacagacttttctggctcaggaggacactgagcagagccctgatgctctggcttctgaagatgccagtcggcaaaaggcaactgaaactaaggagcagtggaaggacatgaaggccacatacatggatcacgtggatgtcataaaatgtgccctgtctgaggccttaccccaggttaaagaggctcacaggaagtacacagagcttcagaaggcttttgagcaactcgaggctaagaagcgagtccttgaggagaaacttcagctggctcagaagcagtgggtactgcaacagaagcgtttgcagaacctgacaaagatttctgcagaggtcaagaggcgccggaagagggctctggagaagcttgacggatcccatcaggaactggaaaccttgaagcagcaagcggggcaggaacaggagaagctgcagaggaaccagagctacctccagctgctgtgttcgctgcagaataagctggtcatctctgagggcaaggctgaggacaaagatgtgaaagggcgagcccttacagccaaatccaaatctccttaaagatgaaaggatgagaagagagccgtattcataccctgcttgggctgagaccagattggttccttcactgttgtatctctaggcctaagcctggaagtttgttgcctctgtacaatctaattctccaagctgattcaatctggcatctcttggcttttcagtgaactgttgtgttttgtctcatgctaactttgacagtatattctggcttgttctgtcttcacctgtgtctaacttgctgtccttgcaacctgtctctgtaaaagtgtaccagtgaaactcacacgcatgcatgcacgcacacaggcacgcatgccacaaccacccttttctctcgctgatcttcagtagtctctcctcttgtcctctctttttctttgtcttctctccctaccagatgtgaaagcaactttatgcgcctgctgtaattgttgtctgaggattactgcgagtaagctcaccctttgtagttactaaactggccggctggctgggtcagctccgctgtactggttcataacccggcttcaagttgactgattcaaaggggcctctcttggcttctgactgaactgctctgcttggaaagtctgatggacttcaggaacagaactgtactgactgccctgactcagctgaactcaactacaccaaattcattggttctctctgctgtactgctcttaggtagcctctctcctgtgctgtcctcctgagtcgtgctgtcaaatctctctctgattcatcactttgcccctcaattagactggcagtttcaaacacggcacttaacatttcagttgtagtcacttgatactgcattccgaacttgagtctattgaatccagaatgtgaatccatgcctttgtgactgtgacctcactctcttcagtattgtgtaaaagttttaggaactctccaagtaaatacttggtaattgctcattgatagaacagaaaaatgctgtgtagataataaataaacatataactataagattaaaaaaaaaaaaaaag

SEQ ID NO: 17 - DNA, 1607 bp, Bos taurus
gagttccagagtagagctggagcgcagcctggagcaaaatgggggctgcagagtctgaagtggagactgcagcccgagaggtcctggccaaggtagcagacatccaggagcctgttggttttcaggaggaagctgaactgcctgcccagatcctggctgagtttgtgatggactctcggaagaaagacaagctcctttgcagccagcttcaagtagtagacttcctgcagaatttcttggttcaggaaggcactgcccaggaccagaaccccttggcttctgaagacacaagccggcagaaggcacttgaagccaaagagcaatggaaagagctgaaggccacatatcaagaacatgtggaggttatcacaaattccctgaccgaggcactgcccaaggtggaggaggcccaaataaagcaggcacagctccaggaggcccttaaacagctccaggccaagaagcaaatggccatggaaaaactcagaatagcccagaagcagtggcagctggaacaggagaagcatttgcagaatctggcggaggcttcatcagaagtgagggagcgtcagacaggagctcaacaggaacttcaacgactatatcaggaacttggaaccctgaagcagcaggcagggcaggagaaggacaagctgcagaggcaccagaccttcctccagctgctatacaccctgcagggtaagcagctattcaatgaggcagaggcagagataccacaggagttggatcttcctaaggataagctccaacaggtgacccagccccaggaacagaacactcaggacaccatgggaagagaggctgacaacccacagcctgttggagatgcaggcttaccatggcttcctggcagacagcaacataaggaagaatcctagagcaggccctgatttgctatgaactgaagttgcagaagtggacttaactgaccagtcactggccacttggagcataatgataatgaacaagtcaataggatggtttcagtatgtgtgacaacagggttgcaaactgaaacagtaataaagagcaatagtgaaaaagtatagagacccgcccccccaacctctatattggtctatgatatgtgagttggtatttctatttgtgctggtatgtttgtgtttctatatttttgtttgttgctttcattctccattcctctatgtgtctcactgaatgtatgaacagtgggatcactactgtgtttgaggaagtgattacatccctgatctgtagcctattctaggatgtcctaatgttatattcctgatacattttttgtgttctactgttttttttccttgactcatcctttcggattgtcattcatcttcaaatattcgcatgctgaaagactggcttttgtgattctctgttgtatgttttgttctggttcattgatttgtagtagtatcttgatcattttctggcttctgtttttaggtcaagaatatgtttttttttggtaaactttttatcaggtaataaacttctgtatttggacctttatttgttttctcaaataaacatttaaagttaaaaaaaaaaaaaaaaaaaaaaaaaaaagaaaaaaaaaaaaataa

SEQ ID NO: 18 - DNA, 1607 bp, Bos taurus; identical to SEQ ID NO: 17

SEQ ID NO: 19 - DNA, 1708 bp, Bos taurus
agtcccagagtagagctggagcgcagcctggagcaaaatgggggctgcagagtctgaagtggagactgcagcccgagaggtcctggccaaggtagcagacatcctggagcctgttggttttcaggaggaagctgaactgcctgcccagatcctggctgagtttgtgatggactctcggaagaaagacaagctcctttgcagccagcttcaagtagtagacttcctgcagaatttcttggttcaggaaggcactgcccaggaccagaaccccttggcttctgaagacacaagccggcagaaggcacttgaagccaaagagcaatggaaagagctgaaggccacatatcaagagcatgtggaggttatcacaaattccctgaccgaggcactgcccaaggtggaggaggcccaaataaagcaggcacagctccaggaggcccttaaacagctccaggccaagaagcaaatggccatggaaaaactcagaatagcccagaagcagtggcagctggaacaggagaagcatttgcagaatctggcagaggcttcgtcagaaggtaagcagctattcaatgaagcagaggcagagataccacaggagttggatcttcctaaggataagctccagcaggtgacccagccccaggaacagaacactcaggacaccatgggaagagaggctgacaacccacagcctgttggagatgcaggcttaccatggcttcctggcagacagcaacataaggaagaatcctagagcaggccctgatttgctatgaactgaagttgcagaagtggacttaactgactagtcactggccacttggagcataatgataatgaacaagtcaataggatgatttcagcgtgtgtgacaacagggttgcaaactgaaacagtaataaagagcaatagtgaaaaagtatagagacccgcccccccaacctctatattggcctatgatatgtgcattggtatttctatttgtgctggtatgtttgtgtttctatatttttgtttgttgctttcattctccattcctctatgtgtctcactgaatgtatgaacagtgggatcactactgtgtttgaggaagtgattacatccctgatctgtagcctattctaggatgtcctaatgttatattcctgatacattttttgtgttctactgtttttttttccttgactcatcctttcggattgtcattcatcttcaaatattcgaatgctgaaagactggcttttgtgattctctattgtatgttttgttctggttcattgatttgtagtagtatcttgatcattttctggcttctgtttttaggtcaagaatatgtttttttttggtaaactttttatcaggtaataaacttgtgtatttggacctttatttgttttctcaaataaacatttaaagttattttcttctggcttcctattagtattttcacaatcattcaattcgtagatttttctattaaaattatttctttgattcatgagtttcttagaaaaataattttcaaattttttactctatgtgagaggataatctttctaggtttattctaatttagtcagaaaatgtcaaatctataataaaaactttgaaatttagtgacggaagcagttgtagccttgaatgtgatttctttaatgtttcatgttgatttttttttctttttttttcatgttgattttttaaa

SEQ ID NO: 20 - DNA, 2069 bp, Macaca fascicularis
attgtgggaaggcggctgaacgcggcccctagaaggatggaggcggcggagacagaggcggaagctgcagccctagaggtcctggctgaggtggcaggcatcctggaacctgtaggcttgcaggaggaggcagaactgccagccaagatcctggttgagtttgtggtggtatgtacaagatgagagcgagcctttcagaagccagggtctggtcctggctcctcttattgagatacagggcagcattggcagagagcagactttaaggaaacctgtaaggaggtaaggacgttccctgtctctgccctccctctgagcaggactcccagaagaaagacaagctgctctgcagccagcttcaggtagtggacttcctgcagaacatcctggctcaggaggacactgctaagggtctggaccccttggcttctgaagacaccagccgtgagtaggcaggggattggagtagcatctggcctgagtggggaacgaaggaggatttcagataggtctcccatttggctgatgggaaggaggcccagtgttgcaaggaggcaggctagcaggccaccctcactcatgttctcattcctggtggctcatctcaggacagaaggcaattgcagctaaggaacaatggaaagagctgaaggccacctacagggagcacgtagaggccatcaaaattggcctcaccaaggccctgactcagatggaggaagcccagaggaagcggacacaactccaggaagcctttgagcagctccaggccaagaaacaagtggccatggagaaacgcagagcagcccagaaccagtggcaactacaacaggagaagcatctgcagcatctggcaaaagtttctgcagagggtaagctgttgttccctgaggctgaagctgaggcagagaatcttccagatgataaaccccagcagctgactcgaccccaggagcagagtacaggagacactatggggagagatgctggtgtgtccttcaaggctgtcagcctacaacctgctggagatgcaaatttgccatgacttcctggaggacaacagcatggagaaagatcctagaataggtcagacccaacttaggccttggtgtccctggatgcaagtgtggaaagagggaaagcctctctgtgcatctgagctctgctacccatggagcagatggatggtgggaacaggaaagagcttatgttacagtttaacacctcattcccttgctcagcccacccagagctaacccctgtcttcttccccaggcctctgacttccctcaccacccccaaccatcattccaggaaagactgtgaactcctgttgctgttcagcctgattgctgactacatcccagcaagctctggcatctgtggattaaaagccctggatctctctcagttgcgtatttgttcatcttcatatgctggcaggaaaaactattagtacagatactcagaagccaataacatgacaggagctgggactggtttgaacacagggtgtgcagatggggagggggtactggccttgggcctcaggggttgcttccccctatgatgcagacatgctgaatttaattcaaggaggaggagattgctttaggcaggtggttatatgtgggaagataatttattcactaatccaaattttattcatggatccaaatgtttgttgagtcctttctttgtgctaaggttcttgctgtgaaccagagctgtaacagtgaattcatctgactgttttaggttgtatagcctagtgttaacattcttagtgtctttttgtgccttaaaacatttcttgatcactggtttcagatgttcatttataatattcttttcaaagattcagagattggcttttgtcatccactattgtatgttttgtttcattgacctctagtgataccttgatcgtttcctactttctgttttcagatggagaagatgtaccttttttgtaaactcttattttgtaaactcttatttttatcagatgatcaactcatgtacttgaatatttgttttctcaaataaatatttaaggctaaaaaaaa

SEQ ID NO: 21 - DNA, 2070 bp, Macaca fascicularis
attgtgggaaggcggctgaacgcggcccctagaaggatggaggcggcggagacagaggcggaagctgcagccctagaggtcctggctgaggtggcaggcatcctggaacctgtaggcttgcaggaggaggcagaactgccagccaagatcctggttgagtttgtggtggtatgtacaagatgagagcgagcctttcagaagccagggtctggtcctggctcctcttattgagatacagggcagcattggcagagagcagactttaaggaaacctgtaaggaggtaaggacgttccctgtctctgccctccctctgagcaggactcccagaagaaagacaagctgctctgcagccagcttcaggtagtggacttcctgcagaacatcctggctcaggaggacactgctaagggtctggaccccttggcttctgaagacaccagccgtgagtaggcaggggattggagtagcatctggcctgagtggggaacgaaggaggatttcagataggtctcccatttggctgatgggaaggaggcccagtgttgcaaggaggcaggctagcaggccaccctcactcatgttctcattcctggtggctcatctcaggacagaaggcaattgcagctaaggaacaatggaaagagctgaaggccacctacagggagcacgtagaggccatcaaaattggcctcaccaaggccctgactcagatggaggaagcccagaggaagcggacacaactccaggaagcctttgagcagctccaggccaagaaacaagtggccatggagaaacgcagagcagcccagaaccagtggcaactacaacaggagaagcatctgcagcatctggcaaaagtttctgcagagggtaagctgttgttccctgaggctgaagctgaggcagagaatcttccagatgataaaccccagcagctgactcgaccccaggagcagagtacaggagacactatggggagagatgctggtgtgtccttcaaggctgtcagcctacaacctgctggagatgcaaatttgccatgacttcctggaggacaacagcatggagaaagatcctagaataggtcagacccaacttaggccttggtgtccctggatgcaagtgtggaaagagggaaagcctctctgtgcatctgagctctgctacccatggagcagatggatggtgggaacaggaaagagcttatgttacagtttaacacctcattcccttgctcagcccacccagagctaacccctgtcttcttccccaggcctctgacttccctcaccacccccaaccatcattccaggaaagactgtgaactcctgttgctgttcagcctgattgctgactacatcccagcaagctctggcatctgtggattaaaagccctggatctctctcagttgcgtatttgttcatcttcatatgctggcaggaaaaactattagtacagatactcagaagccaataacatgacaggagctgggactggtttgaacacagggtgtgcagatggggagggggtactggccttgggcctcaggggttgcttccccctatgatgcagacatgctgaatttaattcaaggaggaggagattgctttaggcaggtggttatatgtgggaagataatttattcactaatccaaattttattcatggatccaaatgtttgttgagtcctttctttgtgctaaggttcttgctgtgaaccagagctgtaacagtgaattcatctgactgttttaggttgtatagcctagtgttaacattcttagtgtctttttgtgccttaaaacatttcttgatcactggtttcagatgttcatttataatattcttttcaaagattcagagattggcttttgtcatccactattgtatgttttgtttcattgacctctagtgataccttgatcgtttcctactttctgttttcagatggagaagatgtaccttttttgtaaactcttattttgtaaactcttatttttatcagatgatcaactcatgtacttgaatatttgttttctcaaataaatatttaaggctaaaaaaaaa

SEQ ID NO: 22 - DNA, 1890 bp, Macaca mulatta
gattgtgggaaggcggctgaatgcggcgcctagaaggatggaggcggcggagacagaggcggaagctgcagccctagaggtcctggctgaggtggcgggcatcctggaacctgtaggcttgcaggaggaggcagaactgccagccaagatcctggttgagtttgtggtggactcccagaagaaagacaagctgctctgcagccagcttcaggtagtggacttcctgcagaacatcctggctcaggaggacactgctaagggtctggaccccttggcttctgaagacaccagccgacagaaggcaattgcagctaaggaacaatggaaagagctgaaggccacctacagggagcacgtagaggccatcaaaattggcctcaccaaggccctgactcagatggaggaagcccagaggaagcggacacaactccaggaagcctttgagcagctccaggccaagaaacaagtggccatggagaaacgcagagcagcccagaaccagtggcaactacaacaggagaagcatctgcagcatctggcaaaagtttctgcagaggtgagggagcgtaagacagggactcagcaggagcttgagggggtgtttcagaaacttggaaacctgaagcagcaggcagaacaggagcaggacaagctgcagaggtaccagactttcctccagcttctgtataccctgcagggtaagctgttgttccctgaggctgaagctgaggcagagaatcttccagatgataaaccccagcagctgactcgaccccaggagcaaagtacaggagacactatggggagagatgctggtgtgtccttcaaggctgtcagcctacaacctgctggagatgcaaatttgccatgacttcctggaggacaacagcatggagaaagatcctagaataggtcagacccaacttaggccttggtgtccctggatgcagtatggaaagagggaaagcctctctgtgcatctgagctctgctacccatggagcagatggatggtgggaacaggaaagagcttatgttacagtttaacacctcattcccttgctcagcccacccagagctaacccctgtcttcttccccaggcctctgacttccctcaccacccccaaccatcattccaggaaagactgtgaactcctgagttcagcctgattgctgactacatcccagcaagctctggcatctgtggattaaaagccctggatctctctcagttgcgtacttgttcatcttcatatgctggcaggaagaactattagtacagatactcagaagccaataacatgacaggagctgggactggtttgaacacagggtgtgcagatagggagggggtactggccttgggcctcaggggttgcttcctccaatgatgcagacatgctgaatttaattcaaggaggaggagattgctttaggcaggtggttatatgtgggaagataatttattcactaatccaaattttattcatggatccaaatgtttgttgagtcctttctttgtgctaaggttcttgctgtgaaccagagctgtaacagtgagctcatctgactgttttaggttgtatagcctagtgttaacattcttagtgtctttttgtgccttaaaacattgcttgatcactggtttcagatgttcatttataatattcttttcaaagattcagagattggcttttgtcatccactattgtatgttttgtttcattgacctctagtgataccttgatcgtttcctactttctgttttcagatggagaagatgtaccttttttgtaaactcttattttgtaaactcttatttttatcagatgatcacatcatgtacttgaatatttgttttctcaaataaatatttaaggctatacattt

SEQ ID NO: 23 - DNA, 1017 bp, Equus caballus
atggaggtggcggagaccaaggcggaggctgctgcgttagagaccctggcagaggtggcagatatcctggagccaagaggcctgcaggaggaggcagaagtgcctgcccagatcctggccgagtttgtgacggactcccgaaagaaagacaagctgctctgtagccagcttcaggtggtagacttcctgcagaacttcttggctcaggaggacactgcccagggcctggaccccttggcttctgaagacacgagccggcagaaggcaattgcagccaaagagcaatggaaggagctgaaggccacctaccaagagcatgtggaagccatcacaagtgccctgactcaggtcctgcccaaggtggaggaggcccaaaggaagcgggcacagctccaggaggcccttgaacaactccaggccaagaagcaagtggccgcggagaaactcagagtagcgcaaaagcagtggcagctgcaacaggagaagcatctgcagcatctggcagaggtttctgcagaggtgagagagcgtcagacaggaatgaaacaggagcttgagcggctgtatcaggaacttggaaccctgaagcaggaggcagggcaggagcgagaaaagctgcagaggcaccagaccttcctccagctgctctacaccctgcagggtaagctgctactccctgaggcagaggcagagctaccacaagagcgggatcttcctgaacctaagtcccagcaggtgacccagtcctgggagctcaacactggggacaccatggagagagtcggggatgtgtcgtccaaggagctggattttgaggactccctcaagagtggcacaagagttggcagcagagtagagggaggtgtgggcttagcatctcgggtatggggatgctcatgggtccagtggggagatcctcgagcagggtacacccagaggtctgtgggcaagtctcctattgaagtcctgaagcaggcaggaagaaacatgttccttcagttcactttaatattttga

SEQ ID NO: 24 - DNA, 825 bp, Ornithorhynchus anatinus
atggccatcctcgcctcccaggatggacgggaggaagccgaggctgaagtgccagccaagctccttgccgagtttgtgatggactcgagaaagaaggacaagttactctgcagccagctccatgtggtgcagttcttgcaggatttcctggagcatatggatgcagctcccggattccatatctcggaggaggagatccgaaaagaggccaatgaagccaaacaaaagtggaaggatctcaaaggggactaccaggagctggtggagaaaatcgaggaggccatgccacgggttttgcagcaggtggaagctctgcagaagaaacgggaactcctggaggaagccctcagtgaataccaaatgcagaaacactctactgaggagaaactgcgagctgttcaggaacagaagcagcgggaccagaactgcagggcgatgggggtgatgaatgagttccccttagactggaaacagcaggagtggcagctgcgttacctgaagccatcttgtgtgtgcaccctcgctgtgcaacccggtttgctgggttcatccagccttgaggcggtgcggttgatctccgtggagggcctcccgaacccccccgacctgttgctgtacaagggcccgggaggggtcaggccttgtgacccgaacagcgcagacccaaaatccctaaacatggggccctcgctccgtggggcatatgggaaagagcaacaagagctagtgatatatggcgccaagcccagtgtagttttcctcgggcaggaggactggcaaaatggagtcacaattgaggcccctcgcgtctccagctcaggatag

SEQ ID NO: 25 - DNA, 585 bp, Monodelphis domestica
atggcggccgacgtgactgctcgagcggcggcggtagcggaggctctggcttcagccgccgccacgttagaggcccccagcgttcaggaggatgtctcatctgctctgctggcagagttcttgaaggactcgaggaagaaggagaagctgctgtggggccagctgcaggtggtggatgccctccagagcttcctggagcacatggacgaggctgtgaaccccgaagaggagatccgggcagaagtcagcgcagcccataggctgtggaaagacctgaaggccgagtacctaaagcagacagaagccgtggaggccgccctgctgcaggccctggtacaactggaggctggccagaggaagcagcttttattgagaagcactctgcagcagatccagaccaaagggcgggccttggaggagtggaggagcagggctcaaacctggcgaaggcaggagcaggaaaagcgcaggcaagagttaaccgctagagcccaggcccagagagaacgcctggagaatggtggccaacagcaggagcaggtgctgatgctccagggtcaagagacacagagtgcccagaggtga

SEQ ID NO: 26 - DNA, 1205 bp, Canis familiaris
atggcggaggcggaggtcggggcgcgcgcccaggcgctcgaggccctggccgcgctgggggacatcctggagcccgtgggccggcaagaggaggtagagctgccagcccagatcctggcggagttcgtgatggactcccggaagaaggacaagctgctctgcagtcagcttcaggtagtagacttcctgcagaacttcctggctcaggagggcatcgtccagggactagaccccttggcttctgaagacacgagccggcagaaggcacttgcagtcaaggagcaatggaaagagctgaaggccacttaccaggagcacgtggaagccatcacaggtgccctgacccaggccctggccaagacggaggaggcgcagagcaagcgggtgcagctccaggaagccctggaacagctccaggccaagaagcaagtggccatggagagagcgagaacagcccagaagcagtggcagctgcaacaggagaagcgtctgcagcatctggcagaggcttcagcagaggtgagacagcggcagagaggagctcagcaggagcttgagcggctgcgtcaggaacttggagccttacaacagcaggccgggcagaagcgggacaggcttcagaggcaccagaccttcctccggctgctgcacatactgcagggtgagccactgctccccggggcagagacggagcggcctcaagagctgggtattcctgaggctaagccccgggagcagaacactggggatgctgtggggaaagacaggagtgtgccatcccaggccgatggcctgcagcctgcccgagggacaagctcacgttggtttcctgagggacagcaacatgggaaaggaacgtagagcaggacttgaggcctgtttgtgttacactgccatgaagaaaatttgtgtacacaaaaggagattcttctttattttcagaaatcatagcatggaaaatacaacaaaatatacttgaggaggcttctaaaagcaaacggaattctataaacacggagtttactttagatgttaaaatgtaatgttcatgaataatagccacaaacgtcttttgggcaatacacttttcgttttgcttataaaattatacgtaactgaagatggttacactttataaatgtctaatgtgcgttgctatttatagatgcttcttttattaataaaatgtgcaatgccactgtctt

SEQ ID NO: 27 - DNA, 885 bp, Sus scrofa
atggaggcggcggagaccaaagcggaggctgcagcccgagaggccttggccaaggtggcagacatcctggaacctacaggtcttcaggaggaggcagaactgcccgcccagatcctggctgagtttgtgatggactctcggaagaaagacaagctcctctgcagccagctacaagtagtagacttcctacagaacttcttaatccaggaagacactgcgcagggcttggaccccttggcttctgaagacacaagccgaaagagggcaattgaagccaaagagcaatggaaagagctgaaggccacctaccaggagcatgtggaggccatcacaagtgccttgacccaggcactgcccaagatggaggaggcccaaaagaagcaagcacagctacaagagacccttgaacaactccaggccaagaagcaagtagctgtggaaaaactcagaatagcccagaagcagtggcagctgcaacaggagaagcatctgcagcacctgacaaaggtttctgcagaggtgaaggaacgtcagatgggaactcagcaggagtttgaacgtctgtatcaggaacttggggccctgaagcaacaggcaaggcaggagcaggacaaactgcagaggcatcagaccttcctccagctgctttacaccctacagggtaagctgctgttctctgaggctgaggcggaggcacagataccacaagaactgaaccttcctaaggataagcccctgcagctgacccaaccccaggaacagaaccctcaggacatcatgggaagagatggaagtgtgtcctctaaggtcgacagcccccagcccattggagatgcaagcttaccatggcttcctggggcacagcaacatggggaaggatcctag

SEQ ID NO: 28 - DNA, 4270 bp, Homo sapiens
gagggccgctgtcactcagccccgcgggccaatagaaaaggggtgaaccccgccttcttcctgagttgtgctgcgggcatgcgcactgggcgtccccacgccaccgcccatcagctgagaattgcagctgagggctccggggtaggtgggtgacggcggtcggaggtgtaggagggagccgtggaggtccaggtgactgcttagaaaactgcacagcatctgatgaaattagcgaataagaacatcaaccatgtcttacactccaggagttggtggtgaccccgcccagttggcccagaggatctcttctaacatccagaagatcacacagtgttctgtggaaatacaaagaactctgaatcaacttggaacacctcaagattcacctgaattgaggcaacagttgcaacagaagcagcagtatactaaccagcttgccaaagaaacagataagtacattaaagagtttggatctctgcccaccacccccagtgaacagcgtcaaaggaaaatacagaaggatcgcttagtggcagagttcacaacatcactgacaaacttccagaaggtccagaggcaggctgctgagcgagagaaagagtttgttgctcgagtaagagccagttccagagtgtctggcagttttcctgaggacagctcaaaagaaaggaatcttgtatcctgggaaagccaaactcaacctcaagtgcaggtgcaggatgaagaaattacagaggatgacctccgtcttattcatgagagagaatcttctatcaggcaacttgaagctgatattatggatattaatgaaatatttaaagatttgggaatgatgattcatgaacaaggagatgtaatagatagcatagaagccaatgtggaaaatgcagaggtgcacgttcagcaagcaaatcagcagctgtcaagggcagcagattatcagcgcaaatccagaaaaaccctgtgcatcatcattcttatccttgtcattggagttgcgattatcagtctcatcatatggggattgaaccactgaagttataaaggagcacactgtcgcactacattgtctaaattatgtaggaagattcctgtaatcatgtttttttaattattattttaaagctattgtataaaggatggttcccatactttgttatttttattgggggggttggggtggttcctttggattaaatctgatattttctaatactgaaagattttctaaatgtcactgctgacataactcccttggtcttcaatttaatagttgttaagtttttgcccacattgcatatgcctttcatttataatttatttaccctgcttgacttagttttgggaattcgtaaatttaaaggtgtgtgtattctgtttgcatctccctgtcactgtgacacacctagatgtgtgttacttcaattaaaattctcaaatttaattttgatttgcttcagcagggaaaatattctcaataatgtaaaataattaaggtctatacatgggttgtatttttctggttcacaacagcacaaagtgtctttcatttttttgttggttttcttttaagatcttttttaccctgaagtcggtgaatacttttctagtttatttgatactctttctgtgtatatattaagcttttgctgtagattgcctagtaaaattactaaggataggttgtttttacatatggtctatttaagtctgatgtttacgggggaaagtgtagttactaaaaatgtttaacataatttggaagaagagtatgaacaaccaataccaatacctattgcgtttggattcttaagaccccagtttgttattccactaaactagttatcttaaccatatcatctggttttgtgggccattatttaccttcccttatgtcttatagaataatggttaatatttttaggtcaaaattacttttggaaagtaactttcccacaattaactgtttttgagcacctgacaaaatttagtgtttaccttgcgtgccattttgtgtcatccttcattaaaaaagcaattggaggtttgccagttatctcacttccctttttaaatcaatgttgttttaatgcactaatctgaattctgtaaagaggattatcttagtttatactttgtattttataatgttcttgtatagcagctcggtactgaaggcggtgtttaacttggcaagctctgagacttcaaatgggaacaaatagtaagtagctaagtaaaccacatctttgcaaccaaaataaagatgagttaaaaggtatctggttaggcctatttcatgaggactatgctctggtgggaccacaggtcacctgatacttagtgctgtgctgcctgaaacctcagcatggagacatcaccacatgcactgtggccattcagcatctttctggagcaccagttcactccaggtttttattttagggtgtcatcgattttacctactttgtcagactggtagaagttgctttgcatatcagaaaaactccatttttttccacaaaagggattacagaaaactcttttgtgagtgagtgattggaacttagagactcctgttgccagaatcagactgccctagaacagaatggacaatgcagggaggagaattcacacaaacagcacctgttctgaggcctgtgccagcccaccaggcctgctcaaatgtggtctttacttcaagtgcacagaggcacatgaggtttctggtgataaaccagcgtcttaccgctgttttaaagtcccatccccatggctttcacaatcagttccgttttttttgctgtacttgataaaatgtttattctcatacaggtcaagtacatttacttctattcacagtgagtacccaataacaacaaaagcgcttacaaatttggggggcgtgattttagtacctttatttgaagtgtaatcattttaaattattattattttaactggggcagttatcagtggtttaaacaggaactttagtggcttcaatttgtttaagaaacatattaagtttgagggaaaaatttcccatgaaatatttggaacgtaagagtagtattgattagagaaaattaaataagaaacatagtatggtagccaaattttttaaaaaatcttgaacttttctgtaggtcagttttagaactgctgtgaaaagtgaaggttgccctgtggagattaaaattagagttgttttcataactgacagcatggtgaatccatttgagtcaaagtgaagaatttcctcatcaagtgactatacatttgtttttgtgtgctcaaaagaaatactcaaacacagactgatattaaccagccaggtaaattgaacgacaatgtggcattaggtatttggctgtttattggtcgttaaatactatggttttgcaatatgattgatggtaaaagagtgatgtcatattgatactagagtagcttgtttttttagtaggtgtgggaccatctcttttacaagtgcaactcagtctaggacagccatggatgcagtgtctggagttggaccctctgagcccgctggctgccccagtagcatctgcattggtgaccaaggacactgcactttgaagaggtcgccactgggttatttagtgtcttcactgcttttgttaaaaattgtaaaattttgtacacaaaaagttgtgtttttgaatatcaattgtttagacacacctacaatgataaataagtgcctttaaaggcccctctttccatgaaatacatctgtggtttagcaaggaaagtacaaaatagtttatgtagttggtataatttttatttgtgtcttcatgtagaaaaaatgaatgtcataataaaatataaaacttacgtaaagaaaataaagtcattgtccaccttaatagctaaggtccacaagggtaacttatgcagcatttattttttttgaaagtcaaaattgaatttatttctttcacatggctggtttgctgcaatatgaagtttcagaatgggctgaagtaagttgattgagggatttgagttgaatgacattttcaagttcatttaaatatgataaaaattcattggtggtaaataacatctgtctttcctggaaaaaaaaaagttgtgtattttcatgattcagttaaaacaaaaaatgagcctgtgaatcccaggcctttttagtcctccataacatttgaacagtttgacttgtcagcaaagaaatacacttatcaaattttaaaccaatgggagcctgaaagtgttacag

SEQ ID NO: 29 - DNA, 860 bp, Homo sapiens
gtcaacttagcgagcgcaacaggctgccgctgaggagctggagctggtggggactgggccgcaatggacaagctgaagaaggtgctgagcgggcaggacacggaggaccggagcggcctgtccgaggttgttgaggcatcttcattaagctggagtaccaggataaaaggcttcattgcgtgttttgctataggaattctctgctcactgctgggtactgttctgctgtgggtgcccaggaagggactacacctcttcgcagtgttttatacctttggtaatatcgcatcaattgggagtaccatcttcctcatgggaccagtgaaacagctgaagcgaatgtttgagcctactcgtttgattgcaactatcatggtgctgttgtgttttgcacttaccctgtgttctgccttttggtggcataacaagggacttgcacttatcttctgcattttgcagtctttggcattgacgtggtacagcctttccttcataccatttgcaagggatgctgtgaagaagtgttttgccgtgtgtcttgcataattcatggccagttttatgaagctttggaaggcactatggacagaagctggtggacagttttgtaactatcttcgaaacctctgtcttacagacatgtgccttttatcttgcagcaatgtgttgcttgtgattcgaacatttgagggttacttttggaagcaacaatacattctcgaacctgaatgtcagtagcacaggatgagaagtgggttctgtatcttgtggagtggaatcttcctcatgtacctgtttcctctctggatgttgtcccactgaattcccatgaatacaaacctattcagcaacagcaaaaa

SEQ ID NO: 30 - DNA, 2090 bp, Homo sapiens
gccggcgccgctgccactcccgggagcatgaaggaccgaacccaggagctccgcacggccaaggacagcgatgatgatgatgatgtcgctgtcaccgtggaccgagaccgcttcatggatgagttctttgagcaggtggaggagattcgaggcttcattgacaagatcgcagagaacgtggaggaggtgaagcggaagcacagtgccatcctggcatcccccaaccccgatgagaagacgaaggaggagctggaagaactcatgtccgacataaagaagacagcaaacaaagttcgttccaagttaaagagcatcgagcagtccatcgagcaagaggaaggcctgaaccgctcctccgctgacctgaggatccggaagacacagcactccacgctgtccagaaagtttgtggaggtcatgtcggagtacaacgccacgcagtccgactaccgcgagcgctgcaaaggccgcatccagaggcagctggagatcaccggcaggaccacgaccagtgaggagctggaggacatgctggagagtgggaaccccgccatctttgcctctgggatcatcatggactccagcatctcgaagcaggctctgagcgagattgagacgcggcacagtgagatcatcaagctggagaacagcatccgtgagctacacgacatgttcatggacatggccatgctcgtggagagccagggagagatgattgacaggatcgagtacaatgtggaacacgcggtagactatgtggagagggccgtgtctgacaccaagaaggccgtcaagtaccagagcaaggcgcgccggaagaaaatcatgatcatcatctgctgtgtgatcctgggcatcgtcatcgcctccactgttgggggcatcttcgcctagaagccacccaaactgccactccactccaggtgggccactccaaggaggccctggctgctgccacctggctgggctgccctcccaacccccgcctctggctcagagcaccctccctcccggcccccatgctcccttctctgccatgggccctccgtccccgccccgtgtcgtgtgcatgatctctgtgagtgtgcgtctgtacgggaagaggcagagggaggcagccagcggggcgtgatgcagtgtgcacagcgaggagcagacccaggcagggccgccagggtgacacaggccacccttccttgccttcagtaactcggtgggcccaggttctgctcttccctggggaccctaacctcgcctccagctgacctgccctgtcctctccagctgtccccacaagcagagccctgaggggtggggaccagctggccacatggtgctgcttttcaggttaggggagaggtggccctgagggacagcccagctctgagtctcagtcgctgatcactgccagggaggctcaggctgccatggctccaggctccctcccctgcctaggggcaaagtccatcgggtcctgggcctcagcttcccttcccacattcctccggccccaggagcaaccccttgggctaggtctgaccccaggtgtccctctggaaggggctggctggtgccctatttccagccaccccagcagctagggaggcaaagcaggctgcagtcagtccctcaagccagcgttgcatgtttgggatggtggctcctgttgtcttgcgctctgggaagtcagatgtcatttcaggcctgcagtctcatcctgcccttgccatcctcccatcgatgtgccacgtgggtgtcacgtgtcccagatgcagtattcggcagccagccggggagggctacctcctcctcctcaccaccttggggcttctcatgggaaatgtgcccccgccccaggaccctctcccttgtggacaggcagggagatgcatgcgagtgcatgcagcaggggatggggccgtgtccgtgtgccccaccctccctcggctttactcctgcccagtgactgtgaccactgtccgtgttgccttcttgaacagcgattccccccaaccccttcaccaaaggtcttggtacaaccagctgcccattttgtgaaatttttatgtagaataaacatttgtatctgt

SEQ ID NO: 31 - DNA, 1960 bp, Homo sapiens
ccaggctgcacggtaggaccggggcgaggggagccaggcggtcagggcggaggccaagcccgggagatgcggttgcagccgccacggctgttggggcgcctggcgctccgtccgaggcgggtggctgtgaggccaggggagtaggcaggctcccagagagattcttccaagttggcgggtggcgggagagggggccgcgcgccccggcgcagctgctttgtgcgcgcagagagggactcgtgtccctggttctctccaaccctgggacccgttgtgcgggcagtattgggcaagccgcagaacggagcgatttcctccgagaaagttgaggatggagcctttttttccgcaccgtccccgcgatggcatgggccccgagaatgctgccccgaggctcccagtgtgggggagctcggggtcgctgcgcctctagcttgagcgcagaaatccgcgaatcactccgatcttcgcgaactctggcatcttctaggaaaatcattactgccaaaactgaggcgagcttttctggcgggcacggcaccctgcccccagggcgctggccctgggcgatgccccctttccgatctcaggcttggtcaagggcgccaggttccgaattcgcgcttgccgtgcacgccggcatcgagcctcaccaacaccgccgggcaacgtggctggagtagattcactgcgtgctgtcctcacttgttctacaatgagtgccaaatctgctatcagcaaggaaatttttgcacctcttgatgaaaggatgctgggagctgtccaagtcaagaggaggacaaagaaaaagattcctttcttggcaactggaggtcaaggcgaatatttaacttatatctgcctgtcagtgacaaacaagaaacccacacaggcgtccatcacaaaggtcaaacagtttgaaggctccacatcatttgttcggagatcacagtggatgctcgagcagcttcgccaggttaatggtatcgatcctaatggggattcggcagagtttgatttgttgtttgaaaatgcttttgaccagtgggtagccagcacagcgtcagaaaaatgcaccttcttccagatcctccaccatacctgccagaggtacctcacggacaggaagccagagtttattaactgccaatccaaaattatgggaggaaacagcatcctccattcagctgctgacagcgtgaccagcgcagtgcagaaggcaagccaggccttgaatgagcgtggagagcgattaggccgagcagaggagaagacagaagacctgaagaacagcgcccagcagtttgcagaaactgcgcacaagcttgccatgaagcacaaatgttgagaaactgcctatcctggtgactcttcttaagagaaactgaagagtttgttcagcagtttttacaagaattcgggacctccgcttgcttctttttttccaatatttggacacttagagtggtttttgttttttcttttcagatgttaatgtgaaagaaagggtgttgcatttttacatttccctaatgatcttgctaataaatgctacaatagcatcggcttcattttgggtttttgcctcctcccactgtgtgtatgtgtgtatatgtatgttttgaatatgttttctttattaaaaaatattttttgtagtttgaatatgaaatttggaccaaatgataaactgcgctgagtctaaactggcaacatgtatttttttctctgatattaagcaggaaggcattttaatgtggtgacatcagatgttatttttcctagatgaaaataaaagtcaagcagtgattagtttcactcactgtcctagctacacttaatttgaagattaaaattctacattgtggaaaacaattgaatttattgggaaaaacagcagtcttagattttgctccttgcatagtaatcttttgcatgaaccatcaccagcgttcaaaaa

SEQ ID NO: 32 - DNA, 970 bp, Homo sapiens
gggcttcaggacaattcgtgatggcgggggctggttccgccgctgtatcgggggcagggaccccggtggcggggcccacaggccgcgaccttttcgccgaagggctgctggagttcctgcgacccgctgtgcagcagctcgactctcacgtacacgccgtcagagagagccaggtagagctccgggaacaaattgacaacctagccacagaactgtgccgcataaatgaggatcagaaggtggccctggatcttgacccctatgttaagaagctacttaatgcccggcgacgcgttgtcttggttaacaacattctacagaatgctcaggaacgactgagacggctaaaccacagtgttgccaaggaaacagcccgcaggagagcaatgctggattcgggaatttacccccctggctccccaggcaaataacagatgagcctatggactcagtagcacaagtactgttccccagctgccttgtttcaacagacatgcaaagatcctaggagacagtccccatagaccttcagacattaaaaagggagccgtacagtttgtttgaagcacttcgtcttacccatttatgtaggggccccaggaaacctacacacagccagaatgaggttcccaaaggacttacattaattatggctcttgcttcctttcacaaatgagctgaggcctctacttttttttttttaagctgcatacttgaggcttaccttcttcaggactagttaaccagaggggcttcctttgtatgttacatgcctggttacatgggcctggacagcatgtcctctacctgtgacttctcattttcctgtttacactggggatttggagggggcaggcaaagtcaaagtgaatgacctctgtccacccacttttttattgcactggcttgaatacagtagcagtgttgatagaatcattttattcaataaatacttaaaatgaaaaaaaaa

SEQ ID NO: 33 - DNA, 3250 bp, Homo sapiens
gagttcggagtagagatggccgcgcttgcaccgctgcccccgctccccgcacagttcaagagcatacagcatcatctgaggacggctcaggagcatgacaagcgagaccctgtggtggcttattactgtcgtttatacgcaatgcagactggaatgaagatcgatagtaaaactcctgaatgtcgcaaatttttatcaaagttaatggatcagttagaagctctaaagaagcagttgggtgataatgaagctattactcaagaaatagtgggctgtgcacatttggagaattatgctttgaaaatgtttttgtatgcagacaatgaagatcgtgctggacgatttcacaaaaacatgatcaagtccttctatactgcaagtcttttgatagatgtcataacagtatttggagaactcactgatgaaaatgtgaaacacaggaagtatgccagatggaaggcaacatacatccataattgtttaaagaatggggagactcctcaagcaggccctgttggaattgaagaagataatgatattgaagaaaatgaagatgctggagcagcctctctgcccactcagccaactcagccatcatcatcttcaacttatgacccaagcaacatgccatcaggcaactatactggaatacagattcctccgggtgcgcacgctccagctaatacaccagcagaagtgcctcacagcacaggtgtagcaagtaatactatccaacctactccacagactatacctgccattgatcccgcacttttcaatacaatttcccagggggatgttcgtctaaccccagaagactttgctagagctcagaagtactgcaaatatgctggcagtgctttgcagtatgaagatgtaagcactgctgtccagaatctacaaaaggctctcaagttactgacgacaggcagagaatgaagcctttgtatgacagacccatgtatttttggcatgaggaactaacagtccattactctatcttcagcctatcaggatcacagttttaaggaagacttggttttgttgaatatgacaatgaaatctgtgtgtatcagatttttattgaagcattcatcagcagcctcaaccagttttcattgtccatttactagattcaatcgtctctgagtatatagggctgatgttagcaagaccctaaaaatgtccattgaaccctgcttcaaaaaatgaaaacacacctctataaaatgtgtactgggaataagctttgtatttacatacattaggggaattttttaaaatctgtaatgtttggacaaacagatgatattactttgctataaaattataaatgtaacttttaataaagatagccagaatattctaaattagaaattacgtttttgtttccctcaagacataaaacaaatataaacattctaaactgctggatgaatctgaaaagacattaagttcaaattttaatttattctcatattaaatataactccattaaaagtttaaaatttcatgggagaaaatataataaggtaaagaggtagaatcactttcagacttaagaataatgttgatttcccaagtgctttaccttatctgttaaagcgtaagatgaattggtatttgcttcataggcagtttgactgcatgtattagagaatgaaaagaagatatttgtagtaatgcctggaaacttggtgctttaaattaaggtactcctctgctgctgtagaatggattccacacagtggatagctatgggtgattcagaatattatgtttagattcccatttgttaagtttataagttttgtggggaattatgaacttactgtgtactacctgcatttgtgctgtgtgaaaaataaatacaaggattcgtttagctaattcaacttactacaaagacaaatgtctgtttttatttgcctgctaggattgtcttttttaaaagtcatttttatttataggaatatgggtgtttctataggaagaaacaggttttttgttttttgttttttaagataaatttgacaaagttaactgaaatttatctggtccattttattcatgctactaagatgggaatctttaaacacaagggtcagcaagctttggcccatggattggccacctgttacgtaaataaagtttctttgaaacaagcctacactcattcatttatgttttgtctgtggttgctttccacaactgcagagttgtatggcttgcaagtctaaaaacatttactatttggccctctaagaaaaagttaagacacctagtctaatggccttttgggaaaaaacaaatcactaactcataatcatttatatccattattttctgcataaatgtaatgctattgtacagggtttggtagaataaatattcagactgactaaactgttctaaatcctcacaaaaaagtccccaaacaacatgcctcctaaaaaacattttcctatcttttacaagaggtatgaacatttgtagggttccacatttgcatctagaaatccaatgctctttagaatgttattacgaatagaaagatggccaggatgacctttagtgttacatgatgttcagcaaattttaattcaaaccttgatatgcctggacactgaaaagtaaacgcatcacctcctattttataccctaccttctggttcccaattgggagagcacatagagggaaggagacaatatagaaactacggagtccgctggtagtgggctgcatggtgtgacagagcccttctctgtaaaatggaaatgacaccactagccatctcaatagttacaagaattaaaagagatacagtacctgaagtgcttagcgcatggtagcatttcataaatgtttagtgtcaatactaatgctctaataatgtaaattgttaataatttatttccctaatatcaggaaatcccagttgtctatgtggcccagtgcttaaaaacgccttcttgcatgaggggattgaactatacaatgtttgttaactttgtatttgtattttttcctataaaatcttaaaataaaattaggagatgtgttctgatgtaacagtaggattagcaattttcatttattccttccatatatatttactgaatggctactatatgcctggtattgttctttgaaagcagaaacagcaggaaaaaaagtccctccctcatagagtttacattctaaaagggaggaaatagataataaaatatacattacatttaaaaaaaa

SEQ ID NO: 34 - DNA, 750 bp, Homo sapiens
agatgcgaggtgggcgggggcaggctgaaagttggagcaagcaggaagtgaactgagggccaccctgggaggaagccgactaggcgaattcacttactgaccggcctgggctgctctgagacatggaggaagccagtgaaggtggaggaaatgatcgtgtgcggaacctgcaaagtgaggtggagggagttaagaatattatgacccagaatgtggagcggatcctggcccggggggaaaacttggaacatctccgcaacaagacagaggatctggaagccacatctgagcacttcaagacgacatcgcagaaggtggctcgaaaattctggtggaagaacgtgaagatgattgtccttatctgcgtgattgtttttatcatcatcctcttcattgtgctctttgccactggtgccttctcttaagtaacagggaacctctcccacctgcccttctcttcagggacaaccctccataaatgtgtgccaagagggtctcctttcctgtcttcctctacagagaatgctgctcggtcctcctacccctcttcccgaggccctgctgccatgttgtatgccccagaaggtaccttggtcccccggaaggagagaaaaaagagagatggactgtggctgcatttcttgggtccttagagtgggctggagagacctagagggcccagcatgtggctgggaaactgttggtggccagtgggtaataaagacctttcagtatccctataaaaaaaaa

SEQ ID NO: 35 - DNA, 2126 bp, Homo sapiens
gatcggctcgatgagcggaggcgctgctgcggcgctgcggccgacgccgggtccgcaccaactgtctccccctcccagcttcttacctcggcttcctactccttcccccgcccgcccagcaccgccagcccgggagagctgccgggagttccccgggagcctcaggtggtgactatcctgttgagaagcaaaagatactttgcaagtaaaaaatatgcctcccaagtttaagcgccacctcaatgatgatgatgtcacaggttctgtgaaaagtgaaaggagaaatcttttggaagatgattcagatgaagaagaggacttttttctaaggggaccatctggaccaagatttggacctagaaatgataaaattaagcatgttcagaatcaagtggatgaagttattgatgtcatgcaagaaaatattacaaaggtaattgagagaggggagagactagatgaactacaggacaaatcagaaagcttatcggataatgcaacagcttttagcaacagatccaaacaacttcgaaggcaaatgtggtggcgtggatgcaaaataaaagccatcatggctttggttgctgctatccttttgctagtgattatcattcttatagtcatgaaataccgtacttgatttgatgacagagatcttcattaaacaagatctgggacagtaataaaagattgctgcataatttaaatgaaacctatgtgtatataactttcaaaacttctttttcaagaaactaagaggcaagtatcacttcaaattggaacgttgagaatgtccaattatcttctccctttctaacaaaatgttcttttaataattatgtttaaggcaaagagaactagcctctatttttccatatttcaaggatctaatttgaaactagatacttgccagttcattatttgtgtatataaacactgattataatatttcatattaatattttaatggcataaggacttgcattattgcattagggagcgggtcatgctgggggtcaggaagcctgtgtagagtaccaaattatatgctgaaagagatgcataaccattctgtcaatatttgcagaaatatagttcctttcatattacagttgttttgcaagcaatttccacatttataggtgtaacaaaagctaaatgttgtaaatgttgttgccctcaggtataactaaaaacattccagtaaatatatttttgactgtgtaagagaatgtgtagtaatttttttggcattggattatggaaatggaaatttttaaacagtgtgaaaaaacatggtatggcatcataaaactggagataataaagttattgaagagtgtcattggagtatttgaaaatgaccaatatatagctgccagtcatggtccagtctgttttctgttaaactccaataaagagagaccagtcagtcctaatgtgagtaaatgaaatttacaggtaacttacttactccttaattttattttagttaatagcctctaacttccaactatctcatttaccaaaagtacaaaaagtagcaaaaccatctattaatactttgaattttatatctttgcatttcctgttcatccttgaggagatgtatgttgcacaatcaaattttgcatcagccaacagtaatgagtagtagaaagtcaggaacctatgtgtatatatatatatatatatatatatatatatatatatatatatacacacaaacacacacacacacacacacacacacgcacacatatgataatcagtcagtcggtaaccaaatgctagagagtgaccattaacctaagcctgtttttataatgaaaaaatgtgttaactttaaaatatgccaacctccttgtgtcttttaaacaagtcagagtgaaaatacattgtcccctaaggtgtggggagaggaagctttataataaaattagtgattctgcagaaacttgtgcactggatatcttgacaatatgaatataaaactccctaaattaaaaatagggttaatagaaattatcagtatttaaatagggaaaaatgattttatgtttattttatttaggttttatttctttggtcatcttaatgcaaaatgaataaagcatagaatctgg

SEQ ID NO: 36 - DNA, 2863 bp, Homo sapiens
ggagttcgcgcgacgaccgcggggtcggcgggcggggcgaggccctggacggcggcggcagtggggctcctccttctgtttcccagaccgagagccgcgccggcaccatgtcagcttaccctaaaagctacaatccgttcgacgacgacggggaggacgaaggcgcccggccggccccttggagggacgcccgagacctccccgacgggcccgacgcgcccgcggacaggcagcagtacttgcggcaggaggtcctccgcagggctgaggccacggccgccagcaccagcaggtccctggccctcatgtacgagtccgagaaggttggggtcgcctcttccgaggagctcgcccgtcagcgaggagtcctggagcgcacagagaagatggtggacaagatggaccaagatttgaagatcagccagaaacacatcaatagcattaagagcgtgtttggggggctggtcaattacttcaaatccaaaccagtagagaccccacctgaacagaatggcaccctcacctcccagcccaacaacagattgaaagaagctataagtacaagtaaagaacaggaagcaaagtaccaggccagccacccaaaccttagaaagctggatgatacagaccctgtccccagaggggctggttctgccatgagtactgatgcttacccaaagaacccacaccttcgagcctatcaccagaagatcgacagcaacctagatgagctgtccatgggactgggtcgtctgaaggacatagccctggggatgcagacagaaattgaggagcaagatgacattcttgaccggctgacaaccaaagtggacaagttagatgtcaacataaaaagcacagaaagaaaagttcgacaactctgaagacagacggatttccactctattgtgatgaaaagatttgaaagatctttttttgaacttccaagaaatttcatttactattttagtatgtaaattaatgtgtgtttgcaaatgttataatagagtaggtcttaagacatttttgctgttataaggaagtgtttgtcccacattttcctagggttaacacctcaccaagttcttccagcaaaatgcttattagagtttttgtctgagcacagtagcctggccctgcatatcttgggcgtttgattaccatgctggaataagaagagttgcatttctcattttaatgagcatatggaaagatgggaacagaatttcagtcttgcagccatgagcctctatttctcattcctaagccttaccatgagtcagagtgttaagggggcctgtgagccagtcgtttggtggaggagggtccttcccacacctttgtttaggagtcatcattcacacacacacacacacacacacacacacacacacacacactctgagcacattatctgtgattctttcatcctcccagaaaggatcagtgttagaatgggaaatagagtgtgccatcttgctcttttgttggcagatgtccccgcttccctccagccccccatccttggcatgtatattagtaggagggcttcacaccagcactgctcactgcgactcctggaaatgtgtggggaattgggtgagcccctcttccccacgtgctcccatctgtaactctccatctgtgatttgcaacaggtcttccactggctcgaggctgcgaggctgaccgacaggggcgcccaatagagtttgtgggaatggagtattgcacagatgcagctgcacaatggtcttcctccacccctctgggaatcaccattaggcaggcctcagtagggcaaaatgtttatttggtaccgggggtctcctgacctgtctagcattcccacccactcttctgcacttcttgcaaggtaacttgaatcatcacttatttctctgccacctggttttaggactggcactctataaatgacgctgactttgtatagaaggattttgctaagggggcaaaaagcccagataccattttaactggcccagctcattttctcctttcattttacaaaagaaatcatgcagaagcatcaattaaaactgatttatttatgttggtacatccaacaaaatagttggagccacaaggcccttgtctttttaaaaaaacaaaatattttgaagatggtgaaagtgactgattttaataatgagataggtcacttaaaataacagtgcctttgaccttaaaacatggcactggcccatgtgacctttgccatttcccagtacttccctttacagtctgcagcctataaacagtggtgtctcaaagcaaaggaaacctccacaagtgctgcaacagtgcattagtttttatgtagcaatttgtttataaaaattcccatcccataatgcatgaccttcctaaaaatacccacagcctccataggcaaggtgagctttctgtgctacccactggttagattccagccacctcagggattctgatccatgtcattaacgaccatcccagggtgtgagggcctgattaaagcttatcgaactagacatttgtttattagatgagctcggcattattattttctcaataactggtagaagggaaattttaaacataacactcaacccaaacaaaactacttcgtgaggctttcagcaaaaaggctgcttaaaagcatgaacccgggatgcagagcagcttttgtgcacggttccacttactgtaattgtttctggttctttcctctaacaccttccatgtatgtcaactttttatcaccgtcaggcatagactcgtggagattagtcattatagctcagacctaagctaattatttaaaataaatacatgtaaaggccactgccacattctcagcaga

SEQ ID NO: 37 - DNA, 2159 bp, Homo sapiens
tctttccgtcccgggcagccagcgccagtcggagccagcgcgagcgccgccgccatcactgccgctgccaagtcctccacccgctgcccccgccatgtctgctaccgctgccacggccccccctgctgccccggctggggagggtggtccccctgcaccccctccaaacctcaccagtaacaggagactgcagcagacccaggcccaggtggatgaggtggtggacatcatgagggtgaacgtggacaaggtcctggagcgagaccagaagctgtcggagctggacgaccgtgcagatgcactccaggcgggggcctcccagtttgaaacaagcgcagccaagctcaagcgcaaatactggtggaaaaacctcaagatgatgatcatcttgggagtgatttgcgccatcatcctcatcatcatcatagtttacttcagctcttaaatccccgaggagtctgccctgcctagagaagggcctctcccccaaccctcagccgttcctccacctctcagccatatctttcagccccccctcccctggatccgtgtgtgtgtgtgtccgtgtgtgtgtccccctgtaaatagccagctgttatttatacatatataatattatatatatttggtctgtttgtagttttattactagatgatttttccggttgtccttaacaccccttcctgaggttcccttcacccctctctcttgccttccttccctttccctttcttcctgactagccccaagtcccttcatttgcatctgctatgcaatagtccctctcctttccttcttcttccctcagatttagctgatccttcctcccaccctggccttcctttcctctttcctcctcactctccccgtcatgctccctctgccccgccctcaaaaaaaaaaaaaaaaaaaaaaaaaaaaaaaaccaccagcacctgtccaggcttccttaggtacatcttctttgtatccattgggaggctctgagactggccccacttggtcctaaaaatcccaaggtctttgggagcgtccagcatgttaattagcgtatcattacatactgctatccctttccatttctttttgttccatcactcttctctcaacctgtgtttctttttttactgaggagttagtccccattagttcttgtatcacattttcatttgcacgacattactcgcaggtggtggggagcctgggcttttggggaaccaggctgctctggtccccagcattgcctcctcctagcccctctagtccagtttgcctcccttaccctcattttccaaacctcttgtaccctcctctccctcccccagtggtatgtaagtgtcttgaagttcagtatgttatgatggaccaataattctgcccttcgggtttctccctacattcctgctccccagttttcatgtggggtactcaactgacattcccatggggtttccctcccatctgcctgatccacctcctcctcccaccacaagatcaattgttggccacaattgatctcttgtagaggggtggctaccagtgtgtgtgtgggggtcatcactgccttggggaggagtggggcagggcagagaatccccccaattcctgcctgaaatctctggcctcacccctgctgggggttggactgaaaaccctcctccccaatttggggggtgttgccccatcactgcccagctcctctgactgccccccctgaatttagggtgggggtactagtcactgccaatgtgtgtatgggacttgctggaaaacggggatgcttgcccctctccaggactattgagcccagagagagctgtcctctcattgggtgaactgattgaggaagggtctattgtctttttaaatggcacaattttaagggtttgagggtacagtcccttaacctgccacgggagggggcccccaaactttcttcccccccacacttctggttttctgtgtggagggggagcagggatatctaagctgtggtgtgaaagggtaggagagatgctggaggtgggggtgctgtgttctagaccccccatattatcccagtgtcccctgcccccctcttcccccaccccatgcccccaattctgtggcgcatccagattgtgaaaatgtacaataaatgtgtaatgagtaaccaggt

SEQ ID NO: 38 - DNA, 670 bp, Homo sapiens
gctcttcctccggggccgctggcactgcggccgctccgcaggcagagaagccgggagcgggcgaggcggcggcggcagcagcgatggcaggaatagagttggagcggtgccagcagcaggcgaacgaggtgacggaaattatgcgtaacaacttcggcaaggtcctggagcgtggtgtgaagctggccgaactgcagcagcgttcagaccaactcctggatatgagctcaaccttcaacaagactacacagaacctggcccagaagaagtgctgggagaacatccgttaccggatctgcgtggggctggtggtggttggtgtcctgctcatcatcctgattgtgctgctggtcgtctttctccctcagagcagtgacagcagtagtgccccacggacccaggatgcaggcattgcctcagggcctgggaactgacccagctggtcctgaaggagaagccaaatggctgcactggccgattctggtctccagaggaccttggtgtttgctctcccttgacccaccccagtgagtgccaaagggcagccccaacatgtgcacccctgcatttcctgtcatgccacagactggcccttgagggcagcctgctgtactggccatgctgggccagccccacctggagctcagtaaaaactgctgtttgataaaaa

SEQ ID NO: 39 - DNA, 2053 bp, Homo sapiens
catctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactcgatcgtgtcgaagaaggcatgaaccatatcaaccaagacatgaaggaggctgagaaaaatttaaaagatttagggaaatgctgtggccttttcatatgtccttgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactcc

SEQ ID NO: 40 - DNA, 2053 bp, Homo sapiens
catctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactggaacgcattgaggaagggatggaccaaatcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactcc

SEQ ID NO: 41 - DNA, 2588 bp, Homo sapiens
gaattcgccggtccagcctcctctgggagcgggcagttggcgaccctgcactgacccgcgtccctccgtcccgagcccgcgcgccctcagagggtgcccggacagactgaagccatggcgattctttttgctgttgttgccagggggaccactatccttgccaaacatgcttggtgtggaggaaacttcctggaggtgacagagcagattctggctaagataccttctgaaaataacaaactaacgtactcacatggcaattatttgtttcattacatctgccaagacaggattgtatatctttgtatcactgatgatgattttgaacgttcccgagcctttaattttctgaatgagataaagaagaggttccagactacttacggttcaagagcacagacagcacttccatatgccatgaatagcgagttctcaagtgtcttagctgcacagctgaagcatcactctgagaataagggcctagacaaagtgatggagactcaagcccaagtggatgaactgaaaggaatcatggtcagaaacatagatctggtagctcagcgaggagaaagattggaattattgattgacaaaacagaaaatcttgtggattcttctgtcaccttcaaaactaccagcagaaatcttgctcgagccatgtgtatgaagaacctcaagctcactattatcatcatcatcgtatcaattgtgttcatctatatcattgtttcacctctctgtggtggatttacatggccaagctgtgtgaagaaataggaaagaagaagttaccattaaccaaggatatgagagaacaaggagttaaaagcaatccatgtgactcaagcctttcacatactgacagatggtatctgccagtctcttcaaccctcttctcactttttaaaatcttgttccatgcctccaggtttatctttgtcttatctaccagtttattcctgtgaacttcagattgaaccattcattgcagcagtagccttaaaaaggcttttgtttatttctttggtttgttaactagtgtcatctatttagagaaacatttttgtttttaattgctcaaagctgtcgccgctagtcttatgagctatctactaaaactatggagaaactttgtatgtgcacacaaaagtattcaagagacagtattgctaacatctcatcttaatgtcttttgttattgagaagttttaggtgcttcaaaacaatataaatggataatagttgttatttggggaattgtaatgatgttggtgctgcttccttctaagagctcagacaagtaaagtatgaaacattcttatttcagttagatggggaacattttgctagcccattagaagcacacagaattatccttgtcctcctaatattgactttcaggaataaagttcagtgtgctgatcattcacaatacagtggatagcttgatatcttctgttttcccattgcagttgatttgagaagatgaaggtttaaatattgttgaaagttgcagttttttaaatgtgttcctttttcttctgtgaatatttagggcaatcgtgtcgctaatagaatatgtagtagagggggtggggaggtaaattcctctgacttgccaaagaaaaagaagggaaccacagtggatatgctagcattttagctgtgcaaagggaggtagtgtgggaaaagtgtttccattctgggaaaagcccaaaccgaatacggtcagcagtcaactccagggtttgggcttgattcctgttgaataatagttttgagcattctttgtggttaaataaattcttaaatctgcctagttttgatgaattcttttgtgaaacttgaaagagaatagacagtatgacatatagaattaatacaaaacagtttaacaaccatttaactgcagtgtaagaaaattggactgtaatcatatcgctactggcatctgttatctagtatgcatttctggtgtgtatctgaaaggaagacattttctaccctagatccaattgcatttatttatcaataagtgccattaaattgaaattatattacattttacactttctcaatgaatgaacaaattagtctgtagaatctagccacctgtttagcctagtcatgtgccttgaacatatatgtgtcccataatctggctcatggtacctgttcttctatccaaacctttcaattcatgctacctgattcatttatttgacatagatcttaggcccacttgaactcttttcttgtttatctagcatagcacaaacgtttttccagtcttctttatcaacactaatgcctcttaattgcatcagtatttcctattggaaaatacatctgttccagaaaaacatttggcattcctgaataatttccaaatgtttttaatccaaagaaaaaggtttaaagcttatttccctttcttatacacacctgaataaaattgatgtgcatgttttagggatcaattacctaactgttccttggtctatttatgtataagaatgctttttaaagcacatgtctcattttaaatgacgcacaaactgaagatgttaataaaatttaaggaattc

SEQ ID NO: 42 - DNA, 1753 bp, Homo sapiens
ggccgcggcgccccccggcgcccccagaccccggcctccggcacagaggcgggagacccggagcagcagcagaggcaggaggactaggaggaggaggaggagccgtcgcaggatgaaggatcggactcaagagctgcggagtgcgaaagacagtgatgatgaagaggaggtggtccacgtggatcgggaccacttcatggatgagttctttgaacaggtggaagagatccggggctgcattgagaaactgtcggaggatgtggagcaggtgaaaaaacagcatagcgccatcctggccgcacccaacccagatgagaagaccaaacaggagctggaggatctcactgcagacatcaagaagacggccaacaaggttcggtccaaattgaaagcgatcgagcaaagcattgaacaggaggaggggctgaaccgttcctccgcggacctgcgcatccgcaagacccagcactccacactgtcccggaagttcgtggaggtaatgaccgaatataacgcgacccagtccaagtaccgggaccgctgcaaggaccggatccagcggcaactggagatcactggaaggaccaccaccaacgaagaactggaagacatgctggagagcgggaagctggccatcttcacagatgacatcaaaatggactcacagatgacgaagcaggcgctgaatgagattgagacgaggcacaatgagatcatcaagctggagaccagcatccgcgagctgcacgatatgtttgtggacatggccatgctcgtagagagccagggagagatgattgaccgcatcgagtacaacgtggaacattctgtggactacgtggagcgagctgtgtctgacaccaagaaagcagtgaaatatcagagcaaggcccggaggaagaaaatcatgatcatcatttgctgtgtggtgctgggggtggtcttggcgtcatccattggggggacgctgggcttgtaggccccccccacccttctctctcccagacccttcccccaccacatcgggagcaatacccccaccacccctttcactccatcccctgctccaggctcactcccaaaacagacccaggcagccccacccccacggcagaccctggtgtccctggacctcaccgggccatggaccccccccccgtccccgcacgtagatcgcagcaggcgtgattacacatgcacaccaacatgcatgccgccggcacatgctcgagacgtgtggacaccccagcgtgcgtgtgcgtgtgatgtgtgtgatgcaccagagcaccccctccacccccaccttgggtgtgtgtgcgtggtctgagcttcccccttcaccggggctgttgtgtagactgcagccaagtgtaacacagcagtccatcacgccctctctgtcctctgtgaacagtgtgtgtgcgtgcgtgagaccacagatctgtggacacaccatttgtgtacgtggaattttgtgtttcagtgtttgaacctaatgcaacagcaacaaagccactgatacctgagccctttgtgtctgctacaaaccaggcaggtggtgtgtgtggactcacactcacattctcagaggatccagggaggcccaggtacacacaggccatggcagacaccccatgtctttgttaccccaggggctgtggcatgtcccaggagggtgtgcatgtgtgtgtgtgtgtgtgtgtgtgtgtccaggatgtgcctgaagtattgataggtcttctcagatagagcc

SEQ ID NO: 43 - DNA, 6910 bp, Homo sapiens
ctcgtgatgccccgccccgtcgctcctgcgcctgcgccgtgcccaccgaccggcctcgagcgccccggcgggaggtttttctatatgagtggagaagacagctgttaccagggaggtcatacaacatttttttaggatgtctgaagatgaagaaaaagtgaaattacgccgtcttgaaccagctatccagaaattcattaagatagtaatcccaacagacctggaaaggttaagaaagcaccagataaatattgagaagtatcaaaggtgcagaatctgggacaagttgcatgaagagcatatcaatgcaggacgtacagttcagcaactccgatccaatatccgagaaattgagaaactttgtttgaaagtccgaaaggatgacctagtacttctgaagagaatgatagatcctgttaaagaagaagcatcagcagcaacagcagaatttctccaactccatttggaatctgtagaagaacttaagaagcaatttaatgatgaagaaactttgctacagcctcctttgaccagatccatgactgttggtggagcatttcatactactgaagctgaagctagttctcagagtttgactcagatatatgccttacctgaaattcctcaagatcaaaatgctgcagaatcgtgggaaaccttagaagcggacttaattgaacttagccaactggtcactgacttctctctcctagtgaattctcagcaggagaagattgacagcattgcagaccatgtcaacagtgctgctgtgaatgttgaagagggaaccaaaaacttagggaaggctgcaaaatacaagctggcagctctgcctgtggcaggtgcactcatcgggggaatggtagggggtcctattggcctccttgcaggcttcaaagtggcaggaattgcagctgcacttggtggtggggtgttgggcttcacaggtggaaaattgatacaaagaaagaaacagaaaatgatggagaagctcacttccagctgtccagatcttcccagccaaactgacaagaaatgcagttaaaaaccaaatttcagtattattggtgccaacatgtctatcctgaggacctttgctgctgttggacactccgtcaccttttggaacacaagtatatcaagatagtggctactgatgttcaagtgggattgaagtgtgataaatggatatattttgttgtttgctggggtgttcatggagatgttaagagattgaggccctgggctgagggtatataatgtatgtcaggtaaagtttgaagactgccaaggagcagattttctccctggaaatgtgaaaactgaacctataactctgataaggacttgagatgtgtagaaacgttgggttatggaagactagtttcttccataaccctgaattggagaccttaatgctaagtgtagattattgaggtttgttagtgaggaaaagaataagagttcagaagcctttgttatcagatagcgaaatcagggcctagtgaggagcacaggtcgactacataatggagtccattggcgaaccctattgcaatttggtccaactatatcttctggtgaaggaaattaatgatgtaagaaaatgcaagaggctcaacttctcttccaaaaatcttctggcttctgaactcttcctctgcctctctttaaataaataacacagaatttcaagtggtaggagacttattaagccagtcaccaagcttggtctgtcagcctgtcttctaacacctcaaagatcttgtgccctgtgctgtccctcccttgtaattatgaaaagttctttggtttctggggtgaattctacccatgtataatgaggaattctctcataaccttttttgtcttgtctgtcatctctgttcatcccttcctataacctctaggtaaaaagaaaagaaaaaaagaaatttcgagatattttcaacattgttagagtttgggctaaaatgagcaaggagaaaaaaaccaccaagaacatttcctggggcatgttccagttttgaggggtgatatatctgccagatagggggtatctgacccagtcttcttttcagctggtctctggggggagctgagaactcgcttgctacctcacatccttttccccagactttttatctcctatgcatccctttgctttctatagctggtgtttcttccccaaaatggcgttcccatgcttacctttctcacattctagacaatgatggacaaagacgcatgcaagactcagacccggggaatggtgtggtgctaatctcaacacctgacattcacagcaagcatggcccagcccaactgcatgtctatctcaaaccgcagaaaggctttaatactggaaaaaaagaattcaagactacaggcagctcccctctgtaccccaactcatttaaaataggaggaatcactttttgccttacttaacgcttttttctgagcacagggatgggcacctgcaccccagaaggtgtgagctgtctctctgccaggagctaaggttcattaggggattggatggtttatcacttctttctttctgagtttacttttagtaacttttattgatggctacctttcatgtccctgtctaaagagactttctctttcatacgtcttaaatctcatcaatgaaatccagtgaaacagcaccatttcttagtatcattaaataactagaaagtatcaagtattgctctctgctgctttatatcattaacatattaataataccaagaaggaaatactttgaataagtgtcagattctgatccagtattggacacctgtgatattggacacctgtgaggctgggataattacttttgaattacacctcttctctagtttctggaccttgctctgtcactttaacacagggtgatcaaacctgaatgaggatcagaactcacccaggcacatactaaagcaagattcctaaacctcagttccaggggtaattctgacatcacccgtccagcatagtcagctgaaattataaatctaagaaacagttacatcaagattctgctgtgtcatttaattctgaaactcccagtattctacccttcttcatcactgcatattaccccactcttccatcccaaattggctatcctttcagcccaccaacttagcggcagcactagggattcattataaggtaaatctggtttacataaagacctgaaggaggcctgtatttgaagctcacacttggtattggtatctctcatttttactgagccagtgtggaataccactgtatgtactcatataagcccttgacttttactgctcatcaggattggaatattactctagcagtcttcacacataggcaagttacagtccttttaaaaagtatctcatttccctataatggaacctaatagccaactttttcatagaaattgctagaagagtttgatcaactataaatgataaagtgtttataagcatagtcagtgtgacacagaaaccaatcttaaaattgaatttaatgttttatcatatcagattaaatattttctccatgtcttatttttactgcaacaagttagaaagtgggaacactttgattaatgtcttaaaatttgtgggccctcatttggataaaggcagcaatcctaaggactttttttttttttttaacataatctgagaatttctctgtagagcagagactttcaaaccttttggctgtaacccacagtaaaaaacgcatttatatcaaaccttagaatatgtttaatgaacaatacttaccattctgatgctttttattgtttcagtttttaaaatatgccagttgcaacccactaaattgatatctaccaatgggttgcaacccttagcttgaaaaaaacaccctcacagaggaactggtatttcttgaataccttctgtttgccaggcacttcaccaggcattttacaagtaaggaaactgggcttcagagaaaataatttgcagaggtttactcaactacaaaggggtgaagccaggaatgttaactaggtctgttgagctacaaaaacttttatgtctctcagactatacagcctctatacaaaattgagatgggggttgggggcaggggctcatgcctgcaatcccagcacttagggaggcagaggccagaggatcacttgagcccaggagtttgagaccagcctgggcaacatagtgagactcttgtctgtatgaaaaaaattaagaattagctgggtgtggcatagcacacacctgtggtcccagctacatgggaagctgaagtgggaggatcacttgaactcaggagcagccttggtgacagaacaagaccctctctcaaaaaaatatttaaaaaaaggtgggtcatccattctcctttaccaaacaggctttgaaatgacacattccattcatttgcatctttttaaaaaacttctgattccttactgagtgtccagcagcctcaaagtttttaatggtagctgatgcagacataaacagtgctcaatttggcccttaaactataaaatcaagaaagagtatttcaatcccatccacctgcctgcaagatttcttaatgttcactagttataaccattgtttaaacagtgctttttgtgtaatttaaaaataaactttaatgctttttaaaacaaatttatcataattcatagatcaaatgattatcctttaaaatgatacccttgggaaatcatgtacttactgtagtgatgctagtattaatattacttagaccaattttgaaactgttctttcagaattgcctccaaagacattttgcagatcatcccagaaaagggggtatgatggtgctgtgtagaactgaccagagttcctggaggattttgaggttatactgaaactgagtgctgtacagggagaattgcatgagtccagaaacttccttctgtgggctgcctgccttcctgccctcccttaagtgctctaagatttttgtacaggagtaagaatcaaatactggtaacatcaatcacaagaagttgaggaaacctgtaatatagctagataatatacaacgtttgtcttccatcagagtgcagaaaccaaaccatgctttgtgttaaccttaaatatgaaaggtgtttctcagggtcccctttgtccttcgttgctgccatatgaaatcttacaaggaaggatgaggaaaagcctggggggaggttctcctcggaaatgaggtggttttttttgttattaagtagaacgtggctgtggttcacaggtacttaacgaatgttagatgatgttcttaagtaatcagaggcctaataaaaggcaggggagtttctcttctagcctaaattaatattaaaagttcaggggtattttttgtttttaaattaatactttattgtttttaacaggtggttctcataatttacattcattaatttgatgcccttttacaaagaaacttcttaggtattataaaccatcaatgtaaaggatccacatggtatgtatccacattgctactctcaaatagaaatgggagataagaaatatatctgtgcaatattaaattgaaaaaaaaaaacccataaaaagtgtcaaaggcaaataatttgctctagatcacaaaactagttagcacaaggctaggattataaccagggtctaggaaaaaatcctgaaggtgatttaactgagtgttaggccctgtcaagccacctgctaaggctcatggtctttcagactagcttcaacattccaaatcaggcaatagctacaacggaaagataattggacggggaatcctgagatcagagtcctagtttggctttgtctcttgtagcaggattttttaaatcaggggcagctctcttctcccatcccagccatgaatctttcaaccttagtggtcaccaacttgactccattccttatatcaagacttgtcctgtcaattctcccttaaatgttagttgcatccatttctaaatatatccatggccatcaccctagtaaaaagactattacctcacaccccgcacttgatcttcccccaactttaagtgactcagttccttatatcactgccacaagaattaacaaccatgtccatctttcatttttctgctgaaagattttcagtggttcccactgaataccaaataaagttcgaatcccttagattggcattcacagccttctacgttctggccccagctttatctcttgaaactcactactcaccatctgacaatgccactaaaaatccacaagagtgattttaaggtttttctatggtgaaggttcaaactggtaataaaccatgtttacatttttctggtctaaaataatttctatattactttataatagtcagctgggggttatttaagctcttggacgagcctaaaacttgtatcctgaagaaaatatttttttccaccagaagaaattgctttcaatttcttaaccttcaaaacaatgtcagtgttgtcacctgtgcatttgatagccacagcacaagtattcttcaggagcataaatcctccagccttgaatggaccattgtccagctcctgtgaaaaacttaatatttgagaaagacattcaatggtacatgttttctgtacacttcatgagtagttgagattttcttgtattaaggttaatcactaaaaaggtgtttacttgggtttcgttaactaaaccccctaaagatgttttccattttattgttaaacacttggtgttagcaagggtcagcacgagaaaaggcccaatggcaagaatttctgcaaactctgtaaagcttactgaattcatttgtcatttattacattgctgagtggtgcttgaataaggaaacatgcaataaatttacttatttaaccaacaaa

SEQ ID NO: 44 - DNA, 860 bp, Homo sapiens
gcacttccgccctctcttaacatggagccggcggaaggggtggtgtagggccgggcgataatggcggcgtcgaggctggagctaaacctggtgcggctgctatcccgctgcgaggcgatggcagcggagaaacgggacccggacgagtggcgcctggagaagtacgtgggagccctagaggacatgttgcaggccctgaaggtccacgcgagcaaaccggcctctgaggtgatcaatgaatattcctggaaggtggattttctgaaggggatgctgcaagccgagaagctgacctcctcctcagagaaagcactggccaaccagttcctggcccctggccgtgtgccaaccacagccagagagcgagtgcccgccacaaagacggtgcatctgcagtcacgggcgcggtacaccagcgagatgcggagtgagctactaggcacggactctgcagagcctgagatggacgtaaggaagagaactggagtggcagggtcccagccagtgagtgagaagcagtcggcagctgagctagacctcgtcctgcagcgacatcagaacctccaggaaaagctggcggaagagatgctaggactggcccggagcctcaagaccaataccctggccgcccagagtgtcatcaagaaggacaaccagaccctgtcacactcactgaaaatggcggaccagaacctggagaaactgaagacggagtcagagcgtctggagcagcacacgcagaagtcagtcaactggctgctctgggccatgctcattatcgtctgcttcatcttcattagcatgatcctcttcattcgaatcatgcctaaactcaaataaagacccccgcccacctaaaa

SEQ ID NO: 45 - DNA, 3080 bp, Homo sapiens
gcacgcagccttagctccttccccgcccttgctcttcccagtttctccgtcagcctgcgggtcccggctggcggctgcttccggtaggagagcggtgtagagcgagcaggtctcagctcctcgtcatgtcatacggtcccttagacatgtaccggaacccggggccctcggggccccagctccgggacttcagcagcatcatccagacgtgcagcggcaacatccagcggatcagccaagccactgctcagataaagaatttgatgagccagctaggaactaagcaggactcaagcaagctacaggaaaatctgcaacagttacaacactccacaaatcagctcgccaaggaaacaaatgaattgctgaaagaattagggtccttgccccttcccttatctacttcagaacagcgccagcagagacttcagaaggaacgcctcatgaatgacttctctgcagccttaaacaatttccaggctgtgcagagaagggtatctgaaaaggaaaaggagagtattgccagagcaagagctggatctcgtctttctgcagaagagaggcaaagagaggagcagctggtctcatttgacagccatgaggagtggaaccagatgcagagccaggaggatgaggtggccatcactgagcaggatttggaacttattaaagaaagagaaacggcaattcggcagctggaggctgacattttggatgtcaatcagatatttaaagatttggccatgatgatccatgaccagggtgatctgattgatagcatagaagccaatgtggaaagctcagaggtgcacgtcgaaagagccactgaacagttacagcgagctgcttactatcagaaaaaatctcgcaagaagatgtgtatcctggtgcttgtcctgtcagtgattattctaatcttgggacttattatctggctagtttataaaacgaagtgattgcctccgatcgttctcccgctgagctgttttcaagggcaagtgcttgttgaagtcttgccagaacaaactgatcacaagaagacagcatatatcagaacgtcctgtaatcatttagttagaaactaactactaactagtctttggaattcgtgacctatggagacagtaattatcaatttattgattctattgatttctcaaattaggaattaacttatgtggattttgcttcctcttgtattctgattgcccttcatcccaagtgtttactgaaaattccattctagatattcttgttttgacaaatgacactacagtctcgtaatattgtcttttatgtatatacaaaatttacctttttactagcatctgagatagagttactttctggtacccagtatattggagtctgtcagaaactctataataggccaccagtttttattatttaacatttttatttgaatttctaagaagcctattctctatctattttgaaagattttggcactatatttaattggaaggtaaaatattgtacatgtgatccagagtaaatgagaagtctctatctgagctggtcagttactggagtacatgttactaatctgggtttaaagtttacttcattatctgctagtgtcatccacagcagttcatcctcatccacactaagccatcctgttagcttttaaaggaagttaatttaattaacattaatatactctatgggctccctctcccacctgtctgcatagaaaggcagaattagacatagcatgctttggaaaagcaaataggaattgttgggaatgatttaatcttgttgttgttgttgttgttgttcacttgtggttctacattcctggtgaatgatgaatgttgctgtcaaagggctgccccctaccttataagggttgctgggcatttgaaggcaggaagatttttaaagatagattgaggttggtttaaaattattcctgtaaaccaacaataaagcaaagaagaggttcatttttgtaaataacactggtttcaaatagtgatgttagacttaacctaatttataaacaagagattaatatctccatgcatagttttagacaaaaaaagatgtttcaataaaattactgtcttgtaatataaatgttgtccacttcccttttccacaggcctagaacagttaaagggaacataatttgtttaggctcccacataaatgtgaatctggccaacaactttggttcatcctttagtgaattagaggatttggctaccctgagtatatttatattcatttcttctgttctccttctgttattatacttaatcttctaaactaaactaatgtgaacagtagggaagcaagggcccaaatgcataagtttctttgcactgttgcacttacttaatacaaataaatgttttttaaagcttttgtagtatgtttttatgagttaacatcctaatgtggtaggtattaggtaatgtgctgtcatgagaaaaattgagacttccaagaaaactggacaccaggtgagggttggtttggagacggaataggtgtagctgcctttccttgaaaaacagtgtgtagagatggctgagtgcaatggctcacacttgtaatcccaacactttggaaggctgaggcgggaggatcagtatatcggtacgtctgagcccaagagttcaagatcagcctgggcagtatagcaagaccccatctccattttttttttaatgattttttaattaaaaaaaagaacaacaggatagagctgttggggtggcacagtggcccaaagagcagcttcagagataattccttggttctatgatccctgtttaactccaaattacagtcggacttggatacatcatttgtaacattgtaggaaagaaaaaagtcttggttgtgaaaaacgatttgcatttgggtaaaataaagtgaccatgcttttgttctgtaatactgtgtgacctgtggttgttgtaatggtgatcatggagagcaaatatgaacttggcctggattttaaatggcctagaatttgtggtagttgccaaagaggttctcctaggtggtcttaataaacctattcacagaattctccttaa

SEQ ID NO: 46 - DNA, 2510 bp, Homo sapiens
accccaacgccgcttctgcggccaaagtaggttgggagtggaaggtggtggctgctgctccgcagtgtcgggaagatggcgccgccggtggcagagagggggctaaagagcgtcgtgtggcagaagataaaagcaacagtgtttgatgactgcaagaaagaaggcgaatggaagataatgcttttagatgaatttaccactaagcttttggcatcgtgttgcaaaatgacagatcttctagaagaaggtattactgttgtagagaatatttataagaaccgtgaacctgtcagacaaatgaaagctctttatttcatcactccgacatcaaagtctgtagattgtttcttacatgattttgcaagtaaatcggagaacaagtataaagcagcatatatttacttcactgacttttgccctgataatctctttaacaaaattaaggcttcttgctccaagtcaataagaagatgtaaagaaataaatatttccttcattccacatgaatctcaggtgtatactcttgatgtaccagatgcattctattactgttatagtccagaccctggtaatgcaaagggaaaagatgccattatggaaacaatggctgaccagatagttacagtgtgtgccaccttggatgaaaatcccggagtaagatataaaagtaaacctctagataatgccagtaagcttgcacagcttgttgaaaaaaagcttgaagactactacaagattgatgaaaagagcctaataaagggtaaaactcattcacagctcttaataattgatcgtggctttgatcctgtgtccactgtcctgcatgaactgacctttcaggcaatggcatatgatctactaccaattgagaatgatacatacaaatataaaacagatggaaaagaaaaggaggccatccttgaagaagaagatgacctctgggttagaattcgacatcgacatattgcggttgtgttagaggaaattcccaagcttatgaaagaaatttcatcaacaaagaaagcaacagaaggaaagacatcacttagtgctcttacccagctgatgaaaaagatgccccatttccgaaaacagattactaagcaagttgtccatcttaacttagcagaagattgcatgaataagttcaagcttaatatagaaaagctctgcaaaactgaacaggacctggcacttggaactgatgcagaaggacagaaggtgaaagattccatgcgagtactccttccagttctactcaacaaaaatcatgataattgtgataaaataagagcaattctactttatatcttcagtattaatggaactacggaagaaaatttggacaggttgatccagaatgtaaagatagaaaatgagagtgacatgattcgtaactggagttaccttggtgttcccattgttccccaatctcaacaaggcaaaccgttaagaaaggatcggtctgcagaagaaacttttcagctctctcggtggacaccttttatcaaagatattatggaggatgctattgataatagattagattcaaaagaatggccatattgttcccagtgtccagcagtatggaatggttcaggagctgtaagtgctcgccagaaacccagagctaattatttagaagaccgaaaaaatgggtcaaagctgattgtttttgtaattggagggatcacatactctgaagtgcgttgtgcttatgaagtttctcaggcacataaatcctgtgaagttattattggttctacacatgttttaacacccaaaaagctgttggatgatataaagatgctgaataaacccaaggataaagtctccttaattaaagatgaatagcatttctttttggagggtttagagattcttactaatatgttgaactaaaatagaaagaaaatgttgctgtcatgtaatttaaacaatgtaaatattttatggaataatggcttttcaaatacatttcttaaggaactgtttatgattattactggatttgtcatttttgataatttaaatattgctgctgctttgtagatgatgagaagaaatgttaaagtgctttctaaaaggaaattttttcacctttggaggagaatatattagagttgtgggtaatttttcacagccacctatgtacatactaattacccattggatacttatatctaaaagtctcatgctgaagtatagtttttgggaaagaatgattttaaataaagagattgtaaaagtaaaaaactgtaaatgtatatgtatgatagaattgtttcctctaagtgtagtttttctttcaactaaaattcagtttatgtgtaaaataattcagtcattaatagaaatggagtgatttcacagtgtgtactgttttgccacatacttctaaagaacacaattttatataattttgaaatcatgtatgtttaaattagaaaaccaaaaatcatgaacattctaagagaaaataaatatagaatttaaaaaattaaaaaaaa

SEQ ID NO: 47 - DNA, 4580 bp, Homo sapiens
gggaggtgggactgactgagtcttccgtgtgtcgccgccgttgccgcctcagcttcagcctcgttactcctgcggttctgtgactgtgctgctggcgttaacggcgcgaggtgaagggaggtgacggagtgtgcccgcgcgcgcgggggtcccctcagtcccagcagttcccttcgtgcgcggggggcggcgagggtcttcagcagtcgggagaggcccttgacggcgccatgtcggcgggcggtccatgcccagcagcagccggagggggcccagggggcgcctcctgctccgtgggggcccctggcggggtatccatgttccggtggctggaggtgctggagaaggagttcgacaaagcttttgtggatgtggatctgctcctgggagagatcgatccagaccaagcggacatcacttatgaggggcgacagaagatgaccagcctgagctcctgctttgcacagctttgccacaaagcccagtctgtgtctcaaatcaaccacaagctggaggcacagttggtggatctgaaatctgaactgacagaaacccaagcagagaaagttgttttggagaaagaagtacatgatcagcttttacagctgcactctattcagctgcagcttcatgctaaaactggtcaaagtgctgactctggtaccattaaggcaaaattggaaagagagcttgaggcaaacaaaaaagaaaaaatgaaagaagcacaacttgaagctgaagtgaaattgttgagaaaagagaatgaagcccttcgtagacatatagctgttctccaggctgaagtatatggggcgagactagctgccaagtacttggataaggaactggcaggaagggtccaacagatacaattgctaggacgagatatgaagggacctgctcatgataagctttggaaccaattagaagctgaaatacatttgcatcgtcacaaaactgtgatccgagcctgcagaggacgtaatgacttgaaacgaccaatgcaagcaccaccaggccatgatcaagattccctaaagaaaagccaaggtgttggtccaattagaaaagttctcctccttaaggaagatcatgaaggccttggcatttcaattacaggtgggaaagaacatggtgttccaatcctcatctctgagatccatccggggcaacctgctgatagatgcggagggctgcacgttggggatgctattttggcagtcaacggagttaacctaagggacacaaagcataaagaagctgtaactattctttctcagcagagaggagagattgaatttgaagtagtttatgtggctcctgaagtggattctgatgatgaaaacgtagagtatgaagatgagagtggacatcgttaccgtttgtaccttgatgagttagaaggaggtggtaaccctggtgctagttgcaaagacacaagtggggaaatcaaagtattacaaggatttaataagaaggcagtaactgacacacatgaaaatggagacctgggcactgcaagtgaaactccgctagatgacggtgcttcaaaattagatgatctgcacactctgtatcataaaaaatcttattaaattgaccatatctccagacaagattgttaatcagactattctgaatttggggcactggggaagatggtgacaaagactacaaaatcaggggaggctgtttgttgcctaaatgaaaggcgggtacctcagggcttcatgtgaacaattctcaatgcataaaacaccctgttttctgtggtagaccataattagctattgcatgtaaagcaattttgattttcttgaacttgtaagcaccaaagcatgtgtttcccaaaggggtattactgggctcttaagtaccaaatgaaaccctactgttttacttggttccttttccctttagtaggaggacagtgctaactggaattttataaggagtaccctttaaaatacagagagtaagtgaattcatattttatattctagaatgttaactgtggtatttcagaagacagagcttgactcaatgaattgtagaaatataggcttgacttaatttttgtaactgaaaggctttagacttaaaaaaatttattgtgcatcctaaaatctaaaccaattattaatgatcatttattgtaatgagtttgcatttcagctttattcaatgcagtacaaaatagttttctttaagcagtcttttatcaatcaatgctgcactagaaatagattctcaaaagttactaaacattttactttttttgttttttaaaagaaatgcagatgagtgtaaaacatctgttctcaattatgttgatctgtgtgcgcagtactggagcatttacccattcatgttgagcctcaaatgcttgttttctggggtccacaaaagacagttttatacattttgagttgttcataaagtttgtcttgtgatagtcctggcacttaaagacaaatttttctggtagtaaaagttcagatttattactatgtcatgaaacacagtacattcaaatcaaacggcagttttctttctaagtaaatgatttccagtcatctaaaaggtgggcaagatgagataaagacattttgatacagtaattgttttggttgggttttcatgtcagtttatgtttgactaaagctctcttcatatgcaggtttataaatttgttaggtctgttgtcccatgattaaacatggagtgcctcctctctgatttaatattctgcaggtcattgtaacctgctaggcaaagtcacaacattgcattaaagaggtgatagctttgctaatatcactgttttaaaggacgtacagttaaaggaatattaagtgggagaaagcctacaaggcttttagaatattatcagtatcttcatttctggtattcagatgttatgtgataaaacacattttttttggctttcccagatacactatatatttgttcaagggtaaatctataaaatgtatatactttattttgtggttttgctatttataaatttaatgttttaactgttgctcatttatggtttgttttgggtggtggtgttcatctgtatatcaccatgttaatttgtaatggaagtgcacttcgtagtgtatattgttactgacattaaaatactttatagcattgtctctgagcaaaagctagtatttaattgtacaaatgaataagcaagttacatgttattgtttgctcttgacagggtaggcctcttaaaagaaaaaaaacaacttgttttttctttatgaatcccctatgccaaacacataccttccatgcatgacatgagatctgcaaactggattttagccaccgtatttatttagtcaaaaaaattgtccattgtagcagacccgaaaacctttttgctgtgacatgaaaccatgttattcttatcttcttaaaacacagcctgggatggaatggccatggcatttttttcagagaacatcctttatctgctatgactgaatccttaggaaatgtaagctataaccctttgattttcaagaactaccgaataagtgtatgaagaggtggttttttaaaacttcaagttggaatttttatgaggtcactgtgtaatttgaagaattgtgtgagattgtcatgatataaattccttttaaggactgataaatagaatgaaaagtttccaggtagtttaaaactccacaggtcagtttccttttcattcctgcttcactgtggtttataagcctacgggagagcaccgttgctcagatgctactgtgagcttcctgtccggtgttagaaagtaactagttaaaagttcattttagaatgtatggtttttggggatgaactaagaattagttattagttccaaaggactgagaaccaattttaatattttcacatttataggaaagaaattcatatgtccctgaaacttctaggacaaaaccaaacaagtaaggagggaactgttgcaaagccatttcatcgagaaggggacagaaggagaaatacacacatgtatacacaaacagaatggttgagaaaacgttttaataaaatgtgagggttgtatgtgtgcgtgtatatatttacacttaacctctaaaattctcttctacagtatctctgttatgaatatgatggaaaagcaacattttggtggtgagactattgttaaaataaatttgagaaagacgaaaattttgtgagtcttgataattacaagtcaacagctatcgaaagttagcacagcttgtctgtggtgctgtttttttccccactgcagtggacttatgctgttttcatgtttagaaacaaaaaggtttcatgtgattcatgtgtaagatgcacagtatttgacatcctgattatgtaatccctattccatctatccagtcttacacttatggttggcctcaaatctattgcatttatgataatgtattatatctagttgagtttaatatttttttattagcctgtaaataaagatggcatcttctacattaaaatgatattgatctcatttttttaaataaacattttgtttccttgacgttaaa

SEQ ID NO: 48 - DNA, 2220 bp, Homo sapiens
aaccggaaggggggctgtgaggacgtgttccgaggaagccagagccggagccgtggcctgcggggccggcgacatggatcccctgttccagcaaacgcacaagcaggtccacgagatccagtcttgcatgggacgcctggagacggcagacaagcagtctgtgcacatagtagaaaacgaaatccaagcaagcatagaccagatattcagccgtctagaacgtctggagattttgtccagcaaggagccccctaacaaaaggcaaaatgccagacttcgggttgaccagttaaagtatgatgtccagcacctgcagactgcgctcagaaacttccagcatcggcgccatgcaagggagcagcaggagagacagcgagaagagcttctgtctcgaaccttcaccactaacgactctgacaccaccataccaatggacgaatcactgcagtttaactcctccctccagaaagttcacaacggcatggatgacctcattttagatgggcacaatattttagatggactgaggacccagagactgaccttgaaggtggggtccctgctgggggacagagagaaggcctcttgttttagcctcatccaacagtttagtaactgtgtttatattttgattacgtgtcctcaaattgtgatattttgatgacaagacagagcccttgagtttgggatcctttctgttggagttgagttattgtgagcctgaaagtacccagttcctttgccagtgcttgaaacaaaccatgaagtggcctctcttaggatccaggtcttttcccatttactgaacttatcatgaaagtgagtgctactacgaggggtccaatcacaggctgagaaattgtgttacagaatctactcttggaagaatgaagacgtggctgtcctttggtacctcgctttaaggtggctttcccttaggacccctactgtggactgccttataactaaaaccttttgtattttagtaactgaatccccactgtgcagtgttagggctgcctggttgtttgcagtagattagagctttagaagcttctagagcttctaaagcccgtgctggtgatcccagcgactcttcactccctagccttaggtattcctagaagccctgaccagttggcactgctgagactccagcccctgggagtggtttacagaaacattacacagactctgatgtcagtcatgatgtttcagcctctgcccttttcctgtatcaaccctgatggataatagggcgtgggttctgtctgttatcagggtgtggtcccctgtgaatgaagcactcccagccactgagctgtgagaaacagtcactcggaagtgtgagctttatcttagtttttgttggatcatgttgagtctgtcagctccacaggacttcagtacgtttctgaacagtccctgccatctctacgggggagagggtcaggcaagctgcaagtgacactcacctcctgctgacagttgcagtgtctcagatggcctggaagggtggtctccagcagcctgctgggcgctcccctttcatgagagccacctgcagtgacctgaactgatacatgttgattagtctgccctttctttagaaaactgctactctccttttcatatctcagaaaaacagtagaggccttttaggaccaaactccatgtcacactgatgaagagccagtgggggttagagcgtcctgttaaggcacatgctaacttcccactcaagtctggcagcgctggggcatcagcacacctcttgccacccacactgataccagaggggaaggctgtgaggtggctgggggttgagacttgaggtttctaactttcctctgcacacctgtggctacctggtgtttgtctcttgattccctccacctgcctcacaccctgcctccgtcgggattttccacctacaccattcaaaaggaacataggagagggcatgaaggggctaggctgaagcactctgatgactggggccaatttgtggctgaaaatgaatacattttttgaaatttatggtcattttcaagtgatttagaaggttgatccttagcctcatacagtgatgaaataatctgtgtgttcagagccaagcaggactttagcaagagtctgattgtattgtcactatctcggggaaaaaaaaatacaaatacatttctctgatctctgatggcaatgaagtttgacttgtaa

SEQ ID NO: 49 - DNA, 4950 bp, Homo sapiens
gagctgcagtcagatccggggatggagggagccggagaagaggagtgagaaggccggggaggcaggccctgctgtcttcctgcaggccggcagcctgctggcagtggaggaccaggccgtccaggaaaggaaggggtcaggaggtcgggcagggcctcagcaggttcagacaagtccccagaagggagctgcaggcgccctcgagtccaggccccaagcctggctccggttgtccaaagagggcctaggccaggcctctggtgcggaaactgagtcacagccagacctcagggcacggcctagacgcttacgagccaaagttaggggtagagagcagagacctccggggggtctcagggagtagggggcttcagggcctcccagtctagagccggattggcgagttagacgcttgtagatccaaggttggattggggtggggtctctgggacgttggatcgctacgcaaggattggggggattcaagtgcttagagatcgaagtctgccctgggtagggggagtcagacaattggaaagcctaggtagttatttggggaggggtctctacgccttggcgaagcgcacagctgcatctttttggcttgaggcctgaggccttgtcgagaagcttccgtgaaagggtgggccagccgggccacgagaaagaaagtgaataaatcaggaatataagtgggcggggggcccctgagaggggggtcgcaaagggtgagacatggccaccaggcgtttaaccgacgctttcttgttgttgcggaataattccatccaaaaccggcagctgttagccgagcaagtgagtagtcacatcacctccagccctctgcattcacgtagcattgctgcggagctggacgagcttgctgatgaccgtatggcactggtgtcaggcatcagcttagatccagaagcagcgattggtgtgacaaaacggccacctcctaagtgggtggatggagtggatgaaattcagtatgatgttggccggattaagcagaagatgaaagaattggccagccttcatgacaagcatttaaacagacccaccctggatgacagcagcgaagaggaacatgccattgagataactacccaagagatcactcagctcttccacaggtgccagcgtgccgtgcaggccctgccgagccgggcccgggcctgctccgagcaggaggggcggctgcttgggaacgtggtggcctcgctggcgcaggccctgcaggaactctccaccagcttccggcacgcacagtcaggctacctcaaacgcatgaagaatcgagaggaaagatcccagcattttttcgacacatcagtaccactaatggatgatggagacgataacactctttaccatcggggttttacagaggaccagttagttctggtggagcagaacacactgatggtggaagagcgggaacgagagattcgccagattgtacagtccatttctgacctgaatgaaatattcagggacttaggggcgatgattgtagaacagggtacagtccttgacagaattgactataacgttgaacagtcctgtatcaaaactgaagatggtttgaaacagcttcacaaggcagaacagtatcaaaagaagaatcggaagatgcttgtgattttaatattatttgtcatcatcattgtgctcattgttgtcctcgttggcgtgaagtctcgataagtggcattgggttttcgtgtgtgccgcgcgtgtggatctcccgggtgtgaggggcttggcctgcgccccgccagctgcccgcagaggtgcagcctcgaggaatctgagggcgtcggggcagcgaacctttgcatccacggactcctccttccctagtcctgctcaagcggtccggggaatgggtttttgtttttccttcattgttgagaatttaaggacctttgatactgctgcacaatagagattgagttctgggatcagttataatatatattttttttagaaagagaaaatgagctgagagtttacaggcactgcagaagctgttcagtattatatgtgtatatgctatttttttagcagccatgtctgagcagaatgttaacataatttttggaaaaattttctttaaaccatctggtttttaagaaatttggtaccaaaaattgatgagtagaggcaaaaatgccccttcatctttctctatatattttccagttgaaaacaaactaagaagtcctttaagaatttataatccgttccccattaacttaatttagcttttccatcactgttaatgatcagagtaacaaagtgtgaaaaataagaaaccatcattgatgttaattaacacatttagatgggccagttaaaacagcttcataagttttaaattaattgtaaatggaatattcctcatttaaaatttttgcactgcattttctactgtaaaccaaaagaggttactaagcaaaaccacctaaatttaagttggtgatttaaatgaatctcacattaaaagaaagcttgacagtgttatgaaagccaccagactcagccagtgtgtccccatgggtatccccagccatccttgctcaatccattacttatatactaactacataatgacctgttcaaaccagactctatttaatgaactgtgaatttacacagaggccattttaaatgggtcaccccatttaggattagtggatctcaaattattaaccaaacatcactccatttcaaagtaaaatattccaccagcgatttgatttattggctcttccattgccactgagcaatgcccaggaagcaggcacattgccaaggactgggggcatcttgactaggaagctcctcgtttgtgtgagcgtgggtcagaccgccaaagtaggacttcatcgtttacctacctattatcaatatggtgcttgaatatattcctataactgtagaacagtgtggaaagtgatggtaactttgaagttgttcatgttttattggctttgttttaattgacactagtagagttttaatggtctttgtgtaaattttaatggcttttccattgtttttgcttctcttaaaaagtttaagaagaatatgacctcattaaatgtgctgttttatttggaccagtcacacaaaatgtctctctagagttgactttaaagttgtttacagaaatttaaactcaattccagagattgaagttgtccaaacagctcatgggcttagtgtccaaacccctgcccagccttccctttccaagttggtgccacctccaggtagccattggtggttttcctattactgatgtggctgtggaatgataaggtcctagaggggccctggcatttcaggaagcggacctggtattccctgacaaacattgcttaggaaagagggccggagaataagaagccagcacctcatcagtcagccctgcaatgtgagacttccgtagctgttgagagtcactgcaggtgttctttcatcccatctgattttaacccatggttgagacgttccaagttagatctgctgctcttaggtgtggggctgtccacattagggaacttgcctcaaaaacagtccacagtggcaataccggacttctgttcaagctttttaaagtgctgagccttacaaacccctgaaggaaggtgaccctttaagagaggatcatctttttttatatttattttcaccaaatagggtgatgagggttggtttttgttccctcaacccatttgggtaaaataacggatctgattagaaactgttttaaggaggggctgggctcggtggctcacgcctgtaatcccagactttgagaggccaaggcggtcacgaggtcaggagttcgagaccagcctagccaacatggtgaaaccccgtctctacaaaaaatacaaaaattagccgggtgggacacgcctgtaatcccagctactcaagaggctgaggcaggagaatagcttgaacccgggaggcagaggttgcagtgagccgagatcacaccactgcactccagcctgggtgacagagcgaggctccgtctcaaaaaaaaaaaaaaaaaattgttttagcgctgggtttcccaaggtgggagagacagacccagcctggagctggcccctggcctgtgtgctgacttcttggggtcctcaaaccactgtatttttctgttgagcctgtacttggggagagatcagtagcatttgaggaagtaagagaaaagaatcatggtacctcagggtttctttccctttactcgctggcagccattgtctgtgggcacctcatgtttttccacactctactgggccgtggaggtaacgatcacccaggccagtctcctctgcctgggatgcgccctctgagaggaggcctagcagggcaggctccctctgggcatccctggatgcagcctctggacacatgcctcctttaaagtgtccgggtgcagctcaggttgagtggaggtagaaggagaaacagacatgtttaccacgcgttttccaaagctcctgatctttcccaagattgtaactgaaaactgctgtctcttgttttgttcgttttgggggtggtggtgctggctgggccatgcttgtgaagtgatgtgtgtctctgatttaacggattcactgttttctctgctaattgagagagcgttatttacattatttatttgttttgacacaagtgctttcagtgttttatcctagctaatggcttcttaaaggtaataaaacccttccaacgtaattggtcagataaaactttttttcttgtatgcttaaataaagcaattagtgaagcacttctatccaaaatgacttttttgtccttttttaaaaccaatttactgttactggaaactttttgtacaataaagcaatcacgcagattaaagaacatcctgcaatcctagtattaattttaaaa

SEQ ID NO: 50 - DNA, 2739 bp, Homo sapiens
agtaagttccagcgcagctagaccgcggggtagtcggcgcgaggcggagcttggcagttccgtccacttcagccgcagcgtccctcgccgggtgtctcgccgcagcctccggagaggaacagaccctcactctctctgtcagaaaaatgtctgctccagctcagccacctgctgaagggacagaagggactgccccaggtgggggtccccctggccctcctcctaacatgaccagtaacagacgactacagcaaacccaggcacaagtggaggaggtggtggacatcatacgtgtgaacgtggacaaggtcctggagagggaccagaagctgtcagagctggatgaccgagctgatgccttgcaggcaggagcatcacaatttgagagcagtgctgccaagctaaagaggaagtattggtggaaaaactgcaagatgatgatcatgctgggagccatctgtgccatcatcgtggtagttattgtaatctacttttttacttgagaatgtaccaccccttccctgttgtccattgccatccacattcatgtcctctgccctctgtttgctctctcaacacacttccccacccaccgtcctccattccagcccaggcttctccatcacccattcctcctttttcgttgcgttcatttgcactctgtccctcaacactagaaatgctgctcgtggcacaatctaagtcattacccgaagagcaacagctggcgcctcctccctgcctgctttttctgtactctcaagttcccccaaagccccaaagagttggaggccaagggaaggggcagggaggggagtggctgaggcgaagtacccatgaagctgcccagacttgggaggagaagagtatcggtgcccatggtgacttctagaaaacctggccactggtaggagctagggaggggctgggaagatggcagctcactcagtactgcctggtcatgtggagctttccttcctggaccaggcctggagagggtcctgggggtggaccaaagtccaacttggtttcagtgcagtacccttttcgaaagtaaaaacttgttttttgtagttatttctaatctgttcgtccaggattttccgtgtctttggggatcttacaactttactttgttctccagaggcctggagaacacttagggattgtgaaaatagcaggacttgtttccatcctagaagcagtcccatgtgcttctagctggaaggagctttctcttctttacattttctacagcattctgtatgagggcaccaaataaatccatctagctggtagttttatctagccaaataatttaacctagctcccagttaattgttggcataaagagagagattgcctgttagttatagagaaacagtgagtcaagtgcttaatttgaaagtaacaagctcagaggaagccactccttgccctcgttaaagagggtcctgttcctctcttcctgttgatgaaggagcgtgagggtgttagcagtgtgagatctttggacacccatggaatcctttcctccacaccacccgtgcacttgccaaagacagggatgaggcaagtggttcttcctggggcccggccgatcctcaggatgcagagaagtcatgtagacccaccagccccaccttggggggaggcgtgccagcctgtgtcaggtgtgcttgtgtattgctgtgctgtcatggggccctctccttgagagccgcctctctgttcttcctgtagtatattcccctttgaaccaccctttcctgtctgaattctactttgcctcctttctcttcctcctctttgcatggtttgtgtgtatagacagtggaacctgaggatgggatctgctcagcctatcttcggggcaattgctgagcttcaggatgggctattaatgtgggataagcccaggtgcaaggggaggagggcaggctgggaacagagcggagaatgcccatggccctttattccttcttccctcggtccacgaacaggaagaggctgaggccatgctgggcagggtctggatgcccactttccatgcagcagcatttcattgctcaaaaccatccttcctttcctttcgcccttgtttcccacattcccttcgtcctgcccaagggcgggactgaagagctggaagaaagcagtcagtaccctcccaacggcccccctcgaaggtctccactctcctctgggctcctccttgcctaatgcagggggtcaccgctggagaagaaccaccactgtcctcgatgtgtcccaagcctggagcgaatccgtcctcttggctctcccagccctatcacaggaatcattcctgggtttctgtccctctgaggctcaccaggtgtagttggccttgttctttgggggtattagcccttctactttctttctcacccaccctgtaccctcttctgtgtgtctctgctatccccctttcctcccaccacccatgtgcatgagcaaatgtgcaacaaaaccctgggactttgcagtcaaatgaagctgagcttcccacatcccgttcttcggtttgccatgagacgatgtggggtttccactgtgtgtctgtcatcacctctttgtctttttttcctaaccctgatctcatacttgtatagagtaataacaacagttgtacttccaccaaaggcatgtggcatatttaccaatgtcatgtattctgaacaaaggcaaaaaatacaaattcctaccattaaaaaa

SEQ ID NO: 51 - DNA, 2160 bp, Homo sapiens
agtccttcagcggccgggttcgcgccgcggtcgccggctgcttacgtgggcgggcctagtgtggggctgagggtgcgggtcgctatggcggtggacatcacgctgctattccgggccagcgtcaagaccgtgaagacgcggaacaaggcgctgggagtggcggtgggcggcggggtcgatggcagccgggacgagctgttccgccggagcccccggcccaagggcgacttctccagccgggcccgcgaagtgatttctcacattggcaaactgagagattttcttctggaacacaggaaagattatattaatgcttatagccataccatgtctgaatatgggaggatgacagacacagaacgagaccagatagaccaggatgcccagatattcatgaggacctgttcagaagcaattcagcaactacgaacagaagctcacaaggagatacattcccagcaagtgaaggagcacaggaccgctgttttggatttcattgaagattacttgaaaagagtatgtaaactttactcagaacagagagccatccgagttaaaagagtggtggataagaaaagattatctaagctggaaccagaaccaaatacaaagacaagagaatccacatcttctgagaaagtttcacagagtccttcaaaagactctgaagaaaaccctgccactgaagaacgtccagaaaaaattttggctgaaacacaacctgaattgggaacgtggggagatggcaaaggcgaagatgagttatccccagaagaaatacaaatgtttgaacaggaaaatcagcgactaattggtgaaatgaacagcttgtttgatgaagtgaggcaaatcgaagggagagtggttgagatttccagactccaagagatattcacggaaaaggttttgcaacaggaagctgagattgacagcattcaccagttagttgtgggggcaactgaaaatatcaaggaaggcaacgaagacataagagaggccattaaaaacaacgctggcttccgcgtgtggatcctcttcttcctcgtgatgtgctccttctccttgctcttcctcgactggtacgacagctagccagggccacgggggcccagcacgagagtcctcatgggcactcacagactgcgtgctttcatgtacttccagtgctggagcatggtatgaccagattttatcacagtgccatttgaagggaaaggagttcagacagacagacgtattccccaaaaagggataccccaggccgatggtgttcagccatttagcagctgaaaaaggaaacagtgcacaccaatgggaggcagcctgcgtagccctcatcaggcaagacagactgaatgcaggagtgggtgattagctgctccttgaacttgaggctgccttggcagcaggggcacagcaggcctcaagagcccctaattgtctcagggttcaaaggaagacactgacctttcccatcccggtagcttcagggaagatcatagttaataacgtctctcaacaaatgattacttctttgtttccttgtggcttcttgtctgtctgagtcaacgaatacacagacttactggattatagaagagaaaattcacatctgccttgttaatctaataaatataattacagccccttaatgtgttgtcaatgagtctaagttgacaaattcagtggcagcccagccacctcctatcaatcaatcagggaagaaatgcaggggagactggggccctcagtgaggggctgcctggcattactcctccaaagactgctgcccccagaacaggcagggggtgtgggagggccagtttcccgccactgggtccaaggagcctttgttcaaaggaagaagtgggccacggaagaacgggcctgcttctctcgtgcctgtgcttctgacctccaggaactgtaaacaggaacacctatgtgtaactgaaggcatgagacatctgtacaggaagcatcccagcgcccacatgggcatgagacagtctgcactgcgcctggtgaaatgcgtgtgtgtacagacagtccactgggcagcacaggtatcctcatgttctttatttgcacagagtgaaatgtcagaagttacatgtaaatgaattcacagtcaataaagtccacgtctacctggaaaaa

SEQ ID NO: 52 - DNA, 3330 bp, Homo sapiens
gcagagcgcgcggggcgcggttgccgtggcagcgccggctccagggagggctgctggcgccgggccgggaccgcggggcctgaggcggagaccggagagcccgaggcccggccggaggcagctcgggacaggcttgagcggcggggcgcgctgcccggccggcggggatgcgggaccggctgccagacctgacggcgtgtaggaagaatgatgatggagacacagttgttgtggttgagaaagatcatttcatggatgatttcttccatcaggtggaggagattagaaacagtattgataaaataactcaatatgttgaagaagtaaagaaaaaccacagcatcattctttctgcaccaaacccggaaggaaaaataaaagaagagcttgaagatctgaacaaagaaatcaagaaaactgcgaataaaattcgagccaagttaaaggctattgaacaaagttttgatcaggatgagagtgggaaccggacttcagtggatcttcggatacgaagaacccagcattcggtgctgtctcggaagtttgtggaagccatggcggagtacaatgaggcacagactctgtttcgggagcggagcaaaggccgcatccagcgccagctggagataactgggagaaccaccacagacgacgagctagaagagatgctggagagcgggaagccatccatcttcacttccgacattatatcagattcacaaattactagacaagctctcaatgaaatcgagtcacgtcacaaggacatcatgaagctggagaccagcatccgagagttgcatgagatgttcatggacatggctatgtttgtggagactcagggtgaaatgatcaacaacatagaaagaaatgttatgaatgccacagactatgtagaacacgctaaagaagaaacaaaaaaagctatcaaatatcagagcaaggcaagaaggaaattgatgttcattattatttgtgtaattgttttgcttgtgatccttggaattatcctagcaacaacattgtcctagcaaccatatcccaagagccatttatccttgagactcagaccacatctgcaaccaaatcagcatcctgtcatttcgtgaatgaatctcagacgctgtaacccggcatcgagtgctgaccttgtaatgtatgagttcacggaagaagcacaaccgaacgtcttgttcagtgacagcgccgtaagcacagtgggtgtgatgcgtgaccctgaatgacacactacagaatgtgagcagtgtgagacttctctcactggccttgaaataagaaaatattgaacattttaatattaaaaatatttcagtgttaacaaatgtgcatgaagtttaattaggaaggaatgctttatgttatgaaggcttttttttttttttttgagacggagtctcgctttgtcatccaggctggagtgcagtggtgcgatctcagctcactgcaacctcggcctcccgggttcaagcaattctcctgcctcagcctcccgagtagctgggattacaggcatgggccaccacacccagctaattttttgtgttttctttttagtagagacggggttttaccatgctggccaggctggcctcaaactcctgaccttgtgatccacccacctcagcctcccaaagtgctgggattacaggcgtgagtcaccgggcaggctgttctgaagcttttagatctcaggtctaaggcttcctttccctccctctcccagctagtttgtgctaattaagagaccttttatactgttttattgcctgtttgaagaaataatttttatcacgtttttgtaagatatctataattttaaatgtttataaattgtttaatttattagcatcttaatgtaccccatttttatatactgaatgtggccttttgagtgaaataggaagcttcatggtgttggagccacctttgtacagttgtttaaagtttcccattgtcacggaaaacattggctgcaaagcccctcaaagccctcaagtgccttctgtgagtttaaatgtgctggtgccctccagaaaagcctcggcctcagctccgtttccgcctgttccctcccccaggataatgaatggttactgcactgtaaagaccgtggtctcttttcactaaataggagattcgagtttcccagtttacatgaatgaagtctgaatttaagacggtgatgaaactgaggttcagtactctcgggactcgaggaaattattcctgagacatggagtaattcttacaaatttaaactattgtacagatccacatacatgttgttaagtacctaatgttttgctgaacttttaaaagttaatttccaaaatgtatagggattcatgataattaaacctttttattgctcatttttttagtagaagaatatcacttatttttagacttgtaaaatgtatgaactggtgagcggacatctgttaagagagtcactagtcagaatgttaaaggagtgcatgcaggatgccccaaatgtcgtgaactcttgttactcctgtatgtagtagtgtaagcatgtgacttttaacaccatttggtttgaaactaatgtagagatgcctgattccaaacaggtgtggagaatattgaatggctcagaagccgcgtcccttacttaacacaattccgaatctccctcatccatgatgcgtccattggatcactcgctggtggtcactgtgtggcagttactaggggaattctgcctctgactgttctttttcttttggtctttaaacaccctgtcgtgggatgtgctcactgatttgtggctatgttgaaggtatcacttgtcttgagggttttcaatatttcaggatcatgctggtggcaaaaggactccacgcctctgtggaatcatgtccacagggggacctgcctcccgtgatgtcccacctttccttcaaggtctgtcatatgagtcctccccttttacaacacttattatggtatttttcaagttattcttcttagatttgcagtacctactgaaatttgtgtttttatagttgaagttaggaaaatgctatttgatttgtatttagatatttaagtcacttgtccaatgatgtgtatgtctaagcctcatgtaccgatttgaagtcagacttaaaaatgtatttacagattcacttgagactttttaatcggttcttcaaatatttcatgtttacattaaaaatttccagagaagcataaaagtattcactttcctgccttgtcatttctggaaagattttggggagatattttattgcatattaattaataaattgttctactaggaaa

SEQ ID NO: 53 - DNA, 2940 bp, Homo sapiens
gcgcggcggaggctcccgtggcctcggacgctcctcctagctagcggccgccgcccgccgccgcctgcgcctccagctccttcgccccggcgggcccggccgccgcttccggcagctcacctgggaagcgctcacctgggacgcgctcacctgggacgcgctacctgcctccgggcgcctgggcttcaggatgaaggaccgtctggagcagctgaaggccaagcagctgacacaggatgatgatactgatgcggttgagattgctatcgacaacacggcttttatggacgagttcttttctgagattgaggaaactcggcttaacattgacaagatctcagaacatgtagaggaggctaagaaactctacagtatcattctctctgcaccgattccagagccaaaaaccaaggatgacctagagcagctcacgactgagattaagaaaagggccaacaacgtccggaacaaactgaagagcatggagaagcatattgaagaagatgaggtcaggtcatcggcagaccttcggattcggaaatcccagcactctgtcctttctcggaagtttgtggaggtgatgaccaaatacaatgaagctcaagtggacttccgagaacgcagcaaagggcgaatccagcggcagctcgaaattactggcaaaaagacaaccgatgaggagctggaggagatgttggagagtggcaacccggccatcttcacttctgggatcattgactcacagatttccaagcaagccctcagtgagattgagggacgacacaaggacattgtgaggctggagagcagcatcaaggagcttcacgacatgtttatggacatcgccatgctggtggagaatcagggtgagatgttagataacatagagttgaatgtcatgcacacagtggaccacgtggagaaggcacgagatgaaacgaaaaaagctgtgaaataccagagtcaggcccggaagaaattgataattatcattgtgctagtagttgtgttgctgggcattttagcattgattattggactttccgttgggctgaattaagagtggcctaagaggctgctgcactgaaataaactgatttcactccagactggtgtggccacccttgtcttcagatgagaatggagtctgaatggccttcctgagagcgagtgcgacccgttcctttgtttccttgcaaccacccttggacctgactcagctaacaatctagccctgggggaatgtgatctacctgatgcgaccctgagttctccccagagcctcctcctgccccaccagctctcaagtaccttttctcctggactgtgtggacccacccagctttcttcctccctgttgtgtgtcagattatgccttgcacttgggaaagctcttgtgagactctcccaaggtgctgtatttttctacctcatggagtattctcccagaaactgcaatgtatttttttaggggagtatctttaacaaagcagaatgattcttctaagtttggcaacaagaaggcttggatctgagtcttctacctggcaggatgccaatcctgtttgttgtccgtatgtcctgaaaacatgagggactggcagatgtcattttggtctaaagagctgacttgtttgaaattcagccttaaattaagctcttagttgttcagcttggggggcaactttgatttttctctgtgttgtagtctctcatatttactcaaggagggaccaggatgatacagtcatctgaggttatgctttgcaaaaggctgacggtatggaatatgtttccatgtctgagtcttagaaactggctgctcattgttagaaagtgatgctttgtgagactattgtcttggggccaaaaataatcagggattttaaattgggcaagggacaaggtgctagaatcctaagctctggaaatatttcatgacactggtgtattcactcatgtgttccagatgtattctaattgtgtatgaaatgtatgtacacataagtgtgtgtgtctcaggaagtaggaaataaaaatggaagctattatgacctcaaaaaaaaaaagccaactttgagctaggataaaaattgggtaaaggacatttgcttacctgcaaatgaatcactgtggaaatgtgatcttcccatatcatcaagaaacttgttttctggatgaatactgggagaataaaatgagaactctggagtgagctaaattgatcccaattaagtttttctgcttagcagacagaaggtataattttttgacaccctttcccacctggtgcctatgctaggcttgtcctgagaacatccctcagtaacttgatattcacatgacctacaggatgtcccatctgcagggctgagtcagttggggaacaccagaggctacacagtagctcttcctgctactcggttaatgagcttggcaggttctttgtctcactgaattcttatcatggaaacagcagcagcagccgctaggaaatcttcaagtgtagtgtctgtgctaacccagtggtaaatcccttagatcccctgctggtctctggcagtctccttgattttgggtaccatgtatattttccgctttgactttaacgctttctaggatagggtaagcacccttaattcaggcactgtccattagcttcctttgcaaaggctacttatggccggtcacaatccagcactcagacagagccaaggcaatatcctcttgcccatggctatgatgtcagacagtggatgggctccagcaacaagagacaaaataactaaaggcctttgctctcctctgacattgaggcctggggcttacagtttggaatacaacatgtgaaggtttttgttgttgtttgtattttttagatgtaaacttgattattttattgctaatttaaaaataaaaatgactttgtattgattgtga

SEQ ID NO: 54 - DNA, 4820 bp, Homo sapiens
agcggaccgccgcggcccgcgctgtaaccgcggctgccgctgctgctccgggcgggcgttggtgccgtgtgccgaggcgccctgtcaggcgatggggagcggctgggcggggagagccgacggccgcggcggcgcctgaggaacgcagccgggctcgggagcggcgagggcgggccggtccagcggcggaggagcgaggcggggcgaggcaggcggcgcggggacccgcgccaagcagcggcggcctcggaggaagaggggtcgccgcccaggtttcttgcggccgccgctcttgtcgtcgcagtatttcctgttcggattatcttttgcttccccccagctgcctccttaccctcacactcccactcctccgtttccgcggtcgaagctgccttcggccccgggtggtctcccccgcccggggaccccctgtgcctcccctcccgggctgcgggggagcccctccgagaccatgaggaaattcaacatcaggaaggtgctggacggcctgaccgccggctcgtcctcggcgtcgcagcagcaacagcagcagcatccgcctgggaaccgggagccggagatccaggaaacgctccagtccgagcactttcagctctgcaagactgttcgccatggatttccctatcaaccctcagccctggcctttgatcctgtacagaagatcctggcagtgggaactcagactggtgctttaaggctctttggtcgtccaggagtagaatgttattgccagcatgacagtggagctgcagtaatccagctccagttcctgattaatgagggagcgcttgtgagtgccttggctgatgacaccttacacttatggaatttacgtcagaagaggcctgccatactacattcgcttaaattttgcagagaaagggttacattttgccatctgcctttccagagtaagtggctctatgtgggcactgaacgaggtaatatacatattgtcaatgtggagtccttcacactctcaggctacgtcattatgtggaataaagccattgaactgtcatctaaatctcacccaggacctgtggtccatataagtgataatccaatggacgagggaaagcttttgattggctttgaatctggaacagtagttttatgggacctcaaatcaaagaaagccgactacagatacacatatgatgaggctatccactctgttgcttggcatcatgaaggaaaacaatttatttgcagtcattcagatggcaccttgactatatggaatgtaaggtcccctgctaaaccagtacagacaatcactccacatggaaaacagttaaaggatgggaagaagccagaaccatgcaaacctatcctcaaggtggaattcaaaacgactagatctggggagccttttattattttatcaggaggtttgtcatatgatactgtaggaagaagaccttgcttaacagtgatgcatgggaaaagcactgctgtgctagaaatggactattcaattgttgattttctaacgctgtgtgaaacaccatacccaaatgattttcaagaaccatatgctgtggttgttcttctagaaaaggatttagtacttatagaccttgcacaaaatggatatcctatatttgaaaatccctaccctttgagtatacatgagtcccctgttacatgttgcgaatattttgcggattgtcctgtggaccttattcctgcactttattctgttggagctagacagaaacgtcaaggttacagcaaaaaggaatggcccatcagcggaggtaattggggcttgggtgctcaaagttacccagaaataattattacagggcatgctgatgggtcagttaagttctgggatgcttctgcaataactctacaagtattatataagctaaagacatctaaagtatttgaaaagtcaagaaataaagatgacaggccaaacacagacattgtagatgaagatccatatgccattcagatcatctcctggtgtccagaaagtagaatgctgtgcatcgctggagtttcagctcatgtcattatttatagattcagcaagcaggaagtaatcacagaagtcattccgatgcttgaagttcgattattatatgagataaatgatgtggaaactccggagggtgagcagccaccacctttgccaacacccgtgggagggtccaaccctcagcccatccctcctcagtctcatccatctaccagtagcagttcatctgatgggcttcgtgataatgtaccttgtttaaaagttaaaaactcaccacttaaacagtctccaggttatcaaacagaactagttattcagttggtttgggtgggtggagaaccaccacaacaaataaccagcctggcagtcaattcttcctatggactggtggtttttggcaattgcaatggcattgctatggttgactacctccagaaagcagtgctgctcaacctgggcactattgaattatatggctctaatgatccttatcggagagaaccccgatctcctcgtaaatctcgacagccttcaggagccggtctgtgtgatattagtgaagggactgttgttccagaggatcgctgcaaatctccaacctctgcaaagatgtcaaggaagttaagcttacctactgacctaaagcctgatttagatgtaaaggataactcctttagccgatcacggagttcaagtgtaacaagcattgacaaagaatcccgagaagcgatctccgctcttcatttctgtgaaacgtttactcgaaagacggactcgtccccttccccttgtctgtgggttggaacaacgctaggaacagtgcttgtcattgcactgaaccttcccccagggggagagcaaagacttcttcagccagtaattgtgtctccaagtggtactatattgaggttaaaaggtgcaatcttgagaatggcatttctggataccacaggctgcttaataccacctgcgtatgaaccctggagagagcacaatgttcctgaagaaaaagacgaaaaggagaaattgaaaaaacggcggcctgtctcagtatccccctcctcttctcaggaaattagtgaaaaccagtatgcagtgatatgttctgaaaagcaagcaaaagtaatctcactgccaacccagaactgtgcttataagcaaaatattacagagacctcgtttgtgcttcgtggagatattgtagcattgagtaacagtatctgccttgcctgtttctgtgccaatggacatataatgacttttagtttgccaagtttaagacctctgttggatgtgtattacttgccccttaccaatatgcggatagccagaacgttctgctttaccaacaatggacaagcattataccttgtttcacctacagaaatccagagacttacttatagtcaagagacctgtgaaaatcttcaggaaatgttgggtgaactcttcactcctgtagaaacacctgaagcaccaaacaggggattctttaaaggcttatttggaggtggtgcacaatctcttgacagagaagaactatttggagaatcgtcctcaggaaaggcttcaaggagccttgcacagcatattcctggccctggtggcattgaaggcgtaaaaggggcagcatctggagttgttggtgaattagcacgagccaggctggcactagatgaaagagggcagaaacttggcgatctggaagaaagaactgcggccatgttatcaagtgcagagtcattttctaaacatgctcatgagattatgttgaaatacaaagataagaagtggtaccagttctgacaaccagaatccaataagtccaacttcagccagaaggaaaaaagttttccatttttattacattctttaggaaagttaacgttaaagggatgttcgtcactgaatactgttctttcctagcacagtcatgcactgttttacctcagtcatgtggctttaactgaggagtgttcacacgcactcgaaatggagtatatggtgtgtgccagttatgagttgaccatttgggaattaaacaggtcacacgtgacagatgaagaaaccaagggggctgctgaggagacctggtgcagggactaatcctggatcattcctgtattaaactttcatatgccaaaagggtttgtgccgttttatctgccatcagtgtttgacctgtttagggcagaggcaataagtcagaagtcttgaagttgaaatagttatatgtgtgtcattggactggattataaacagctgtcttggactttccctctcttaacactgactggtcatcagtatcattagtgaaaaagaaacaaattgtttgttatcatctctttagacagataagctgaatggtgggctttaaataataaaaacatacacatagttgacttgtgtatgagctactcttggattcttgttattatagacttgtatttagttcatattttgtcaaaagcaaaacaagaagatacatcacttttcattgaaaagaaaagtgtagagcatgactgaattgctcatcattctgggagtttccatgtagtggctatgcagtgtggaaagtgagaaaaacctccattgtggtgaggagaatacttcaatgtcccttgtccttgttctcattaattcagctaaaggtggatttgaccaaaataatgctggttaaatttgtagaaatgttgaaattggctgtgttttaaattttgcttgaatttttataaaatgtttaaccaaatgtacctttgcattctttaattaaaattgcttaaaaaaaaactttcattatttcagt

SEQ ID NO: 55 - DNA, 2148 bp, Homo sapiens
cgcgactagggtgcagcgccaggtccggtgttggggtgtccgagttgccgccggagaggagtggcctcgcccgcttgagttttgattcatcatggataatctgtcatcagaagaaattcaacagagagctcaccagattactgatgagtctctggaaagtacgaggagaatcctgggtttagccattgagtctcaggatgcaggaatcaagaccatcactatgctggatgaacaaaaggaacaactaaaccgcatagaagaaggcttggaccaaataaataaggacatgagagagacagagaagactttaacagaactcaacaaatgctgtggcctttgtgtctgcccatgtaatagcataactaatgatgccagagaagatgaaatggaagagaacctgactcaagtgggcagtatcctgggaaatctaaaagacatggccctgaacataggcaatgagattgatgctcaaaatccacaaataaaacgaatcacagacaaggctgacaccaacagagatcgtattgatattgccaatgccagagcaaagaaactcattgacagctaaagctactgctgttcttctttatcatttattcacttccgtagctcctccttgaaagttattaccttttcagagtttaagttttcggttccacgctcttctaattgggagataatatggaagaagggccagagcagttacagccctccttcttttttgttttctgttgagggccgactgctgctctgccttccttctagtattttctttctcaattcatacgcttagattggttttcatatgtcatgtttagtgttttcatcctcctcatatacttcagcaggttcttttgctttcaagatttggaagcattgccaaagacagccatgaagaaggaagctgtagaggtgttttttgttgttgtttatttttgcttttgtggttgagggaaggacaagagataagaggttgttacctcagtaaaaaccttcaggccacaaagcaaaaagttgcatagccacaacgaagatctagttggatatagtttttgatttaagttgcagttatagccaatttaggctaatgcttggttttggagcttttatacacaacgtttttgttaggcatcacagttttgcaacctctgctccaaagagaaaaatagaatgagttttctttcttttttttttttttggagtcagagtctcgctctcttgtccaggctggagtgcaatagcgcgatctgggctcactgcaacctccgcctccctggttcaagcaattctcctgccttgcctcctgagtagctgggattacaggcgtgtgtcaccacgctcggctaatttttgtatttttagtagagacagggtttcaccatgtcaagctggtcttggactcctgacgtcgtgatccacccgccttggcctcccaaagtactgggattacaggcgtgagccactgtgcctggctgagttttcttaaagtgagcttaatttctgaactcttagtgattcatatatgtacataaatctgtgatcccatttcttattgcaccattcaggaacactttatataaatgagtggctttttatttcatattattagtagtatcatggttccattacaggcctattaacatcatacattgtcattagtctttgaagaaaaaatatgtaaatatatatgtgtaacatgagaatttctctctaaagcagggcttaaaattttttggaaaagtttgacaaagcataccacatgaattcagatttacctcaatgctaagaattatgtttagttaggaaaaaggaaagtcattttgacctcaggtagaaaaatagattgctttgagttttatgtagctttagactttaaaaagttagaatttattctgtaactaaaaattatttgaaaaaattatgcctctggtttaattattggtgattacacactctttctcttacccttgtgtattgaactatgtccataatcaagttgatgtggatcctgaaaagtgttatgaacatctgattggtatttgtcacatttattttaaaattagcatctgaacacttcaaagctgtcagtgtgtattggtttcaccaataaccactgcttgatccttacaattaaattttttaactaac

SEQ ID NO: 56 - DNA, 750 bp, Homo sapiens
atgtctctcgaagaccccttttttgtagtccgaggcgaggtgcagaaggcggtgaacacggcccgcgggctgtaccagcgctggtgcgagctcctgcaggaaagcgcggcggtcggacgcgaggagctggactggacgaccaatgagctgcggaatggcctgcgcagcatcgagtgggacctcgaggacctggaagagaccatcggtatagtggaagccaacccaggcaagttcaagctcccagccggggacctgcaggagagaaaggtgttcgtggagcggatgcgagaggcagtccaggaaatgaaggaccatatggtcagcccaacagccgtagcatttttggagaggaataacagagagatactcgcaggcaagccagctgcccagaagtcacccagcgacctgctggatgccagcgcagtctcggccacatctcgctacatcgaggagcagcaggccacacagcagctgatcatggatgaacaggatcaacagctggagatggtgtctgggagcatccaggttctgaagcacatgtccggccgcgttggagaagagctggacgagcagggcatcatgctggatgccttcgcccaagagatggaccacacccagtcccgcatggacggggtcctcaggaagttggccaaagtatcccacatgacgagtgaccgccgacagtggtgtgccatcgccgtgctagtgggggtgcttctcctcgttctcatcttactattctctctctga

SEQ ID NO: 57 - DNA, 1794 bp, Homo sapiens
gggggtggggttacgtgtaggtgacgtggccgcttccagtctttggtcgggtttcggcggcttcagtgctcggggaggaggcagtgacggccggtgagattggaagtggcggcggcggcaggcggcagaggggagtccgaggttatgcgtctcaatgatcccgcggaaacgctacgggtctaagaacacggatcagggtgtctacctgggtctctcaaagacacaggtcctgtcccctgcaactgctggcagtagcagcagcgacatcgcccctctgccccccccagtgaccctcgtccctccccctcccgacaccatgtcctgccgggatcggacccaggagtttctgtctgcctgcaagtcgctgcagacccgtcagaatggaatccagacaaataagccagctttgcgtgctgtccgacaacgcagtgaattcaccctcatggccaagcgcattgggaaagaccttagcaacacatttgccaagctggagaagctgacaatcttggcaaagcgcaagtccctctttgatgataaagcagtggaaattgaagagctaacatatatcatcaaacaggacatcaatagcctcaacaaacaaattgctcagctccaggatttcgtgagagccaagggcagccagagtggccggcacctgcagacccactccaacaccattgtggtctccttgcagtcgaaactggcttctatgtccaatgacttcaaatcggttttagaagtgaggacagagaacctgaagcagcagaggagccggagagagcagttctcccgggcacctgtgtcagccctgccccttgcccctaaccacctgggcggtggtgctgtggttctgggggcagagtcccatgcctccaaggatgtcgccatcgacatgatggactctcggaccagccagcagctgcagctcattgacgagcaggattcctacatccagagtcgggcagacaccatgcagaacattgagtcgacaattgttgagttgggctccatctttcagcagttggcacacatggttaaggaacaggaggaaaccattcagaggatcgacgagaacgtgctaggagcccagctggacgttgaggccgcccattcagagatcctcaagtacttccagtctgtcacctccaaccggtggctcatggtcaaaatcttcctcatcctcattgtcttcttcatcatctttgtggtcttccttgcttgaaccctctctactctgaggcactctgttggggtttgggaccctcctgggaaggcaagtggccagtgctgccactgagcctgtgcagggtacttgggagaaaggccctgtttccctggaactgctaagaatgaccactgcccctgatcccccaccccttgcctctggccaccctgtcctccccccaccaccctcaggcctatgaaacacacagggttctagatttgaactctgctgtgaagtgactggaagggagcagaggccagctgggggccagtgggggaggttgtttccactaggagatttttataaaccctctccagcctctcccaaaggaagcgttggcagcaaagggagatgatgcccttacccaccttcctgtgagtgaagagaggaagcagccccagggaccaattttcccaattgacctctttcttcctctttcaccatgtgaggcagggagccctgagcccttcagctgcctgcacaacccctgacattggctgctggtgactcaatctgccaaatgtgctgcagctcgttttctcccaattacagcaagactgtcagcctca

SEQ ID NO: 58 - DNA, 4604 bp, Homo sapiens
gggaggtgggactgactgagtcttccgtgtgtcgccgccgttgccgcctcagcttcagcctcgttactcctgcggttctgtgactgtgctgctggcgttaacggcgcgaggtgaagggaggtgacggagtgtgcccgcgcgcgcgggggtcccctcagtcccagcagttcccttcgtgcgcggggggcggcgagggtcttcagcagtcgggagaggcccttgacggcgccatgtcggcgggcggtccatgcccagcagcagccggagggggcccagggggcgcctcctgctccgtgggggcccctggcggggtatccatgttccggtggctggaggtgctggagaaggagttcgacaaagcttttgtggatgtggatctgctcctgggagagatcgatccagaccaagcggacatcacttatgaggggcgacagaagatgaccagcctgagctcctgctttgcacagctttgccacaaagcccagtctgtgtctcaaatcaaccacaagctggaggcacagttggtggatctgaaatctgaactgacagaaacccaagcagagaaagttgttttggagaaagaagtacatgatcagcttttacagctgcactctattcagctgcagcttcatgctaaaactggtcaaagtgctgactctggtaccattaaggcaaaattgtctggcccctctgtggaggagctggaaagagagcttgaggcaaacaaaaaagaaaaaatgaaagaagcacaacttgaagctgaagtgaaattgttgagaaaagagaatgaagcccttcgtagacatatagctgttctccaggctgaagtatatggggcgagactagctgccaagtacttggataaggaactggcaggaagggtccaacagatacaattgctaggacgagatatgaagggacctgctcatgataagctttggaaccaattagaagctgaaatacatttgcatcgtcacaaaactgtgatccgagcctgcagaggacgtaatgacttgaaacgaccaatgcaagcaccaccaggccatgatcaagattccctaaagaaaagccaaggtgttggtccaattagaaaagttctcctccttaaggaagatcatgaaggccttggcatttcaattacaggtgggaaagaacatggtgttccaatcctcatctctgagatccatccggggcaacctgctgatagatgcggagggctgcacgttggggatgctattttggcagtcaacggagttaacctaagggacacaaagcataaagaagctgtaactattctttctcagcagagaggagagattgaatttgaagtagtttatgtggctcctgaagtggattctgatgatgaaaacgtagagtatgaagatgagagtggacatcgttaccgtttgtaccttgatgagttagaaggaggtggtaaccctggtgctagttgcaaagacacaagtggggaaatcaaagtattacaaggatttaataagaaggcagtaactgacacacatgaaaatggagacctgggcactgcaagtgaaactccgctagatgacggtgcttcaaaattagatgatctgcacactctgtatcataaaaaatcttattaaattgaccatatctccagacaagattgttaatcagactattctgaatttggggcactggggaagatggtgacaaagactacaaaatcaggggaggctgtttgttgcctaaatgaaaggcgggtacctcagggcttcatgtgaacaattctcaatgcataaaacaccctgttttctgtggtagaccataattagctattgcatgtaaagcaattttgattttcttgaacttgtaagcaccaaagcatgtgtttcccaaaggggtattactgggctcttaagtaccaaatgaaaccctactgttttacttggttccttttccctttagtaggaggacagtgctaactggaattttataaggagtaccctttaaaatacagagagtaagtgaattcatattttatattctagaatgttaactgtggtatttcagaagacagagcttgactcaatgaattgtagaaatataggcttgacttaatttttgtaactgaaaggctttagacttaaaaaaatttattgtgcatcctaaaatctaaaccaattattaatgatcatttattgtaatgagtttgcatttcagctttattcaatgcagtacaaaatagttttctttaagcagtcttttatcaatcaatgctgcactagaaatagattctcaaaagttactaaacattttactttttttgttttttaaaagaaatgcagatgagtgtaaaacatctgttctcaattatgttgatctgtgtgcgcagtactggagcatttacccattcatgttgagcctcaaatgcttgttttctggggtccacaaaagacagttttatacattttgagttgttcataaagtttgtcttgtgatagtcctggcacttaaagacaaatttttctggtagtaaaagttcagatttattactatgtcatgaaacacagtacattcaaatcaaacggcagttttctttctaagtaaatgatttccagtcatctaaaaggtgggcaagatgagataaagacattttgatacagtaattgttttggttgggttttcatgtcagtttatgtttgactaaagctctcttcatatgcaggtttataaatttgttaggtctgttgtcccatgattaaacatggagtgcctcctctctgatttaatattctgcaggtcattgtaacctgctaggcaaagtcacaacattgcattaaagaggtgatagctttgctaatatcactgttttaaaggacgtacagttaaaggaatattaagtgggagaaagcctacaaggcttttagaatattatcagtatcttcatttctggtattcagatgttatgtgataaaacacattttttttggctttcccagatacactatatatttgttcaagggtaaatctataaaatgtatatactttattttgtggttttgctatttataaatttaatgttttaactgttgctcatttatggtttgttttgggtggtggtgttcatctgtatatcaccatgttaatttgtaatggaagtgcacttcgtagtgtatattgttactgacattaaaatactttatagcattgtctctgagcaaaagctagtatttaattgtacaaatgaataagcaagttacatgttattgtttgctcttgacagggtaggcctcttaaaagaaaaaaaacaacttgttttttctttatgaatcccctatgccaaacacataccttccatgcatgacatgagatctgcaaactggattttagccaccgtatttatttagtcaaaaaaattgtccattgtagcagacccgaaaacctttttgctgtgacatgaaaccatgttattcttatcttcttaaaacacagcctgggatggaatggccatggcatttttttcagagaacatcctttatctgctatgactgaatccttaggaaatgtaagctataaccctttgattttcaagaactaccgaataagtgtatgaagaggtggttttttaaaacttcaagttggaatttttatgaggtcactgtgtaatttgaagaattgtgtgagattgtcatgatataaattccttttaaggactgataaatagaatgaaaagtttccaggtagtttaaaactccacaggtcagtttccttttcattcctgcttcactgtggtttataagcctacgggagagcaccgttgctcagatgctactgtgagcttcctgtccggtgttagaaagtaactagttaaaagttcattttagaatgtatggtttttggggatgaactaagaattagttattagttccaaaggactgagaaccaattttaatattttcacatttataggaaagaaattcatatgtccctgaaacttctaggacaaaaccaaacaagtaaggagggaactgttgcaaagccatttcatcgagaaggggacagaaggagaaatacacacatgtatacacaaacagaatggttgagaaaacgttttaataaaatgtgagggttgtatgtgtgcgtgtatatatttacacttaacctctaaaattctcttctacagtatctctgttatgaatatgatggaaaagcaacattttggtggtgagactattgttaaaataaatttgagaaagacgaaaattttgtgagtcttgataattacaagtcaacagctatcgaaagttagcacagcttgtctgtggtgctgtttttttccccactgcagtggacttatgctgttttcatgtttagaaacaaaaaggtttcatgtgattcatgtgtaagatgcacagtatttgacatcctgattatgtaatccctattccatctatccagtcttacacttatggttggcctcaaatctattgcatttatgataatgtattatatctagttgagtttaatatttttttattagcctgtaaataaagatggcatcttctacattaaaatgatattgatctcatttttttaaataaacattttgtttccttgacgttaaa

SEQ ID NO: 59 - DNA, 3319 bp, Homo sapiens
aaccggaaggggggctgtgaggacgtgttccgaggaagccagagccggagccgtggcctgcggggccggcgacatggatcccctgttccagcaaacgcacaagcaggtccacgagatccagtcttgcatgggacgcctggagacggcagacaagcagtctgtgcacatagtagaaaacgaaatccaagcaagcatagaccagatattcagccgtctagaacgtctggagattttgtccagcaaggagccccctaacaaaaggcaaaatgccagacttcgggttgaccagttaaagtatgatgtccagcacctgcagactgcgctcagaaacttccagcatcggcgccatgcaagggagcagcaggagagacagcgagaagagcttctgtctcgaaccttcaccactaacgactctgacaccaccataccaatggacgaatcactgcagtttaactcctccctccagaaagttcacaacggcatggatgacctcattttagatgggcacaatattttagatggactgaggacccagagactgaccttgaaggggactcagaagaagatccttgacattgccaacatgctgggcttgtccaacacagtgatgcggctcatcgagaagcgggctttccaggacaagtactttatgataggtgggatgctgctgacctgtgtggtcatgttcctcgtggtgcagtacctgacatgagccagccacgctcagtggctgaacagcattcccacagcctgcaagtgtgtgtgtgtgtgaaagagagaggggggcccagaggccgccttttgaaatgtttgcctgtctgaactgtgaagacacttgggagtgattgtggtctaatttccaacctgctctgttttctgtgacatcttggagggggagctagtgccaccaccatgcgcggtgcttaggaaatgaaagaagtcccgggtctgtctctctcactctcgctctcactgggggagggaaagaatggctttggtggctttgttcacatagctgatgcgtgccctgggaaggtgtccacagtgagccctgtgtgcaggactgtccacacggttcacaccttgtcaccatcaggcctttctggctcctgatagggtggagcaaaagtggaaaggaaaggaaagaggccttttctcacagccattatattaaatagtaggtcgattcacatcctcgtgctcctggccaccctcccctgtgcctcagtgacatgtagatgactgactgccaatacttgtcaccattccctggaagcagctacctaggggaaacaagatgtagtgctattgccgataacaagtaagattttccacactacagctgggtgtttctcttttctaaagtgaggccagtgttatttcccgggagtgttcagtcttgaccctagtcactgattttttctagttgttaatagagtggttggcttttaaggttcagagactgtggcttggcacctgcgcccaggctttgtgggcctttgccccttagaaagtagctgtaggcaaagatttgtgattttccaattacagtctcagctctagttttagtatctctaattctttggttcccttctcttccctgaaatatattagcacctgccagccaggccctcattttgcccagccagtgtgggcagatcccaccgtggagacatctgtagtgtgtatgtccttgtaacactctgttttcagggactacaacctttttccttctgtgaccagccccggattcaggctgtactaataccaggtatattgtggaatttagtataaaggccaatctgtcctgaagtccatctaatgtggtgaatcactgaaagtctcagaaagacctggttagtgtatgttctcatttaccacaggcctaccagccctgggcacagcagcttcatggcaagacataaaatgacactcaaaatccttcagatctggaaaccggctcagtattaaccctacctttggttgtcctgccctacctgctctgttagtttcttgttgcttgaactgtcttctgtcttatttcccttcctttctgtgttcctcttcacctctcttgttcccctccccgctgctctgtagtcatgttggtcctttcaggcacctctgtggcatagctcccctttggtaagttttcttaattgtcatagattaactgagtttcctggatgctaatttcacactttcggttggaggagatctccattgttcctacccctccgggccaaatgggccccaggtttccaaggaaggagcaatctgtgactcctaaaatgggttggggccctgccagagttaaagcagtgactggagggtggactggggggttgcagcatctttagacctagatctgtctaactctggggaggcacattgacatttccattacacacagcactgctgcggtgccagggacctagcgcaggacttttggtaatccataaaatggattctgagactgcgacggcaaggctgtcctgtcccccaggcacccaaggatcctgccagacagcacactttggaggaaggtctgcagggagcagctgagccatttgttcttgaactctgggaggcagaagtccccgcacccatcatgcgtggactgataggacatcttttcgtggtgtgcaccagtgctttccacacttgacagtggttggctttgatgaaccctcatgctgcaccttcagagccagtcctctagtttggaataaaaattgcagaggtggtttttgggtctttaccacctgcggctggtggacagcagccagtgtgtctggacacccaggggcattgagactgcatgttgtcacatgaccacttctcttcacacatctgctttcagtgcctggtgaaaaatagaccttggcctaacagtgtgactctctccaccgcctcagtgtagggaagggtccaggccagggaaggagcaccctctagtggaggcgggggtgaattcttaggtcgagctgatgcaagaaactccggtagccagcctctgtgaccttgtacatgagtttggtgtgcctattgtgatttaaaacaggtgggttatcaagaggaacttgagatctctttattacatggacatttacttcagggggaccactgtaagaaaagccaaactccaagaccaagtaagttagaggagtcttgattttttagacttcactgcggagttctgtacaccctttgccctgatgaatttgaatgggtttgatttgcaaatttggatttacacccattgttttggaagcacatcagctgaataaagttgaggtttattttatttagaaaatca

SEQ ID NO: 60 - DNA, 1469 bp, Homo sapiens
aaccggaaggggggctgtgaggacgtgttccgaggaagccagagccggagccgtggcctgcggggccggcgacatggatcccctgttccagcaaacgcacaagcaggtccacgagatccagtcttgcatgggacgcctggagacggcagacaagcagtctgtgcacatagtagaaaacgaaatccaagcaagcatagaccagatattcagccgtctagaacgtctggagattttgtccagcaaggagccccctaacaaaaggcaaaatgccagacttcgggttgaccagttaaagtatgatgtccagcacctgcagactgcgctcagaaacttccagcatcggcgccatgcaagggagcagcaggagagacagcgagaagagcttctgtctcgaaccttcaccactaacgactctgacaccaccataccaatggacgaatcactgcagtttaactcctccctccagaaagttcacaacggcatggatgacctcattttagatgggcacaatattttagatggactgaggacccagagactgaccttgaaggggactcagaagaagatccttgacattgccaacatgctgggcttgtccaacacagtgatgcggctcatcgagaagcgggctttccaggacaagtactttatgataggcacccaaggatcctgccagacagcacactttggaggaaggtctgcagggagcagctgagccatttgttcttgaactctgggaggcagaagtccccgcacccatcatgcgtggactgataggacatcttttcgtggtgtgcaccagtgctttccacacttgacagtggttggctttgatgaaccctcatgctgcaccttcagagccagtcctctagtttggaataaaaattgcagaggtggtttttgggtctttaccacctgcggctggtggacagcagccagtgtgtctggacacccaggggcattgagactgcatgttgtcacatgaccacttctcttcacacatctgctttcagtgcctggtgaaaaatagaccttggcctaacagtgtgactctctccaccgcctcagtgtagggaagggtccaggccagggaaggagcaccctctagtggaggcgggggtgaattcttaggtcgagctgatgcaagaaactccggtagccagcctctgtgaccttgtacatgagtttggtgtgcctattgtgatttaaaacaggtgggttatcaagaggaacttgagatctctttattacatggacatttacttcagggggaccactgtaagaaaagccaaactccaagaccaagtaagttagaggagtcttgattttttagacttcactgcggagttctgtacaccctttgccctgatgaatttgaatgggtttgatttgcaaatttggatttacacccattgttttggaagcacatcagctgaataaagttgaggtttattttatttagaaaatca

SEQ ID NO: 61 - DNA, 4540 bp, Homo sapiens
gggactggaggctgccgagggggccggcgcccgagtccgggattcggccagtggtgctgagcgagtgctggaccagcggccgtcctgtgcacctggcctgtgcgcgtgcccgctgctcggcttcacccagactaaggcgcgggcagctgcgggaacaggcggggtgggcggagggagaccgggaggcacgggcgccctgtgcgcggaggaggtgaaggcggccggggccgggacgccatgtccatggaggaccccttctttgtggtgaaaggagaggtacagaaagcagtcaacactgcccagggattgtttcagagatggacagagctcctccaggacccctccacagcaacaagggaagaaatcgactggaccaccaacgagctgagaaataacctccggagcatagagtgggatctagaggaccttgatgaaaccatcagcatagttgaagcaaatcctagaaaatttaaccttgatgcaactgaattgagtataagaaaagccttcattacaagtactcggcaagttgtcagggacatgaaagatcagatgtcaacttcatctgtgcaggcattagctgaaagaaaaaatagacaggcactgctgggagacagtggcagccagaactggagcactggaacaacagataaatatgggcgtctggaccgagagctccagagagccaattctcatttcattgaggagcagcaggcacagcagcagttgatcgtggaacagcaggatgagcagttggagctggtctctggcagcatcggggtgctgaagaacatgtcccagcgcatcggaggggagctggaggaacaggcagttatgttggaagatttctctcacgaattggagagcactcagtcccggctggacaatgtgatgaagaaacttgcaaaagtatctcatatgaccagtgatcggcgccaatggtgtgccatagccatcctctttgcagtcctgttggttgtgctcatcctcttcttagtgctgtgacggcggggcctctgggtgcgagttcctcctgcatatgaaccgaggggaggaggagaagctgagcacgtgtgacattgccgtctactcacattcctatcctggaaacatactgctgcactgacttttctccgtgtgaccccacaattgacatggctcctccatcccagcgctggaagggccagtgggaagaggaaatagatgtctgcactcctggctgcagctggacaacagaagccccatgccgcctgtccagttcggaggagaactagctgctgccttgccttccgggacctcgtttgctgaggagggacttacagactccactggtgttttgctgttgctcattccatgcatctttggcagctcttttcttctgctcagacccttccccgtgctcagacagtgcaccgctgtcccatctaaagaaacctgtcaggaatacgagcttctgggtatgtttcgtttcccattgctgtagcatttcttatcccctgagagctgatgattattgaggacagaaggctcagaaacagtttgtgacagaaaatgcagtgtttcatttttcagggataaatgctaagataaaattgcttttccaggtcatttttttttgtggtaagaataactaatggaaaataatgaaacaccctggggtttgggggtgctaacaacttgtggctttaactgacaggagcaattaaaaagagcaagagggttctgcattggcatagcttagggaagggttaatgatgtcgccacaggtcagctcctgatccttgccgacttgatgttgctgtaccagggcttcctccccagaggtgcagcttgcgttttgagggtgattgctacatatgttgttgctaaacagctcagtaacacacttgaatgaatttggataccagattgtcctcattacagttcttttactcttagggcactctacactgggggttggggttgggagtggttagtacatttattacatttattaagaaacgtaatgacataaaaggttagctctgggccagacttctcttactctgtgggtaatggcaaggatgtgtaggtaaacttggttcttttttttccctaagatgacagcttgattttatcatctgcagtcaaataactgagccaatccaaatttaaatgatagatgctttaattgagtttaagtagctgaaactgctgagacactaaactttaaccttctgatgactttttaaaatgcctcaaatgtgcacatgtatataggatatttttataacttccctgatgaataatctgatattaaagtagtatttggacccagagccagaactcggtggtggaggctgctggtctctcctcaccaccttcttttgcacttggaaagaacagcaacatctggatagagttctggctttgacttctcatttccttgtctttttgggtgcattcctcagcacactttttttttaaacctttttgttttgttttgtttgtatttcatgtggttttatttgggggttttggttttttcacccttttttgtgatttgcaatgatgtgcttgcccagctaacttttgaattgcactttttaataaatattcttaacaatttttgaagaaggatattttatctcatttgagatcatggtaggttaagaaaatatgcctgttgatgaaagctaaaagcaaatttatgaaactaaaagggtgattgacatccatgtttacactccgctctaatgtttgatatataaataagttattttcaaattaggaaaaaacagtgagtattacaaagggcttcagatgtttagagtactaggttatttatgttttacaaagtttgaatcttctataaactaagaaaggggatgatccttagatttgcattaaaatatagaagtcttttaaagtaaatgtgaaccttgtctaagtactgtaatccacacaacacattataagaagcaaaccagcatcttaaggaattataaaattaccctatttaaaagccatgctattgttctgctattaccagatttattgtgccacacaaaaggatcatgtgtgtcagcaggggccgtttggaacaaacctagtcattaatgagtaagatactcctgttagttcagggaccaagttttatgacccagaggcttaatgatgtttggatatatttcaaatcggcgtgcttacctcactgatttaaattattttctaaatagtggccattgtagacctgactcaggctgaagctaaatagagaacaatttagaaagttaactaacaatacagtgcattctacccgtagggccaccatgcccttctgcccctggctgatttgatcctgtgtctgatcccattgcaccctgactgggcagtccctacagaaccagtgttaatttgaagggcctccactcaggctccaaatgtggcagccaaagagaacaatccagggaacctacatttatttttaaggacaaatatttcctcctcagtggtcctaatgttcagggctttagagggaacccaggtggtctcttcaccctgtgtcctagaatgggagagtaagtagacagtggtgataaccccacactgcttataagtgcatctttatagtatttggggctttcctacccctttagccttctgtacctagtaccatattccagttttaaagaactggcagaatgtgatggataacagaggaagagctcaatttatgtttattggaagaacattttacttaaatgatttgaggggtgggagggagtgaactactgagtttgccagagtgaaaatccatctgaaaaactcagctacctttagtttttagtcctcatttttggtcttgtctctgcggactgtgaagaatcacaatgctctatatgccctggactgtgtggcaaatgcaggttgcagcgtgtgtgttacatgaggatcttccacaatttcagaatgcacgccagagctgaagggggaaacttggtaacttgcccattattctctgcttttagccagagttaaacagactgatgggtctggtagccaacaacttggcaacttccactccttctcacctcgtgagattaagggctgtgaaaagaaatctagtctaactccaacagaaatctgtctctgttaagtgttttaccttctgtaagtagagatggtagagccaagatttttcttttggtaatttccctgtctataaagtgagaccaaagggatatctgttccctgttacctttttggagaattcataacatttgaagatcaaaaaattgaatgataaatatgaatggcttttcaattctgtggactttgtaccatttggcttcaccttgtactgcaagatgaatttgtaaacaaaacaaaattggactgtctggaaagctaaagttctgaaatatggaatgtactgcctctaatttttctttgtcttcctctcactggcatttttttctctcccaggtttcttaagaataatgttttttaaaggaggctttttgcccatcaagaataaaaagaaataaaaccaaaaaaa

SEQ ID NO: 62 - DNA, 5220 bp, Homo sapiens
atcccggctgacgttggacgacaaagatggcggcagggaccagcagttactgggaagatctcaggaaacaggctcgacagctggaaaatgaacttgacctgaaactagtttccttcagcaaactatgtacaagttacagtcatagcagtacccgagatggaagacgcgacaggtatagttctgatacaacaccccttttaaatggatcaagccaagacagaatgtttgagacaatggcgattgagattgaacaacttttggcaaggcttacaggggtaaatgataaaatggcagaatataccaacagtgcaggtgtcccctccttgaatgcagccctgatgcatacattacagcggcatagagacatattgcaggattatacacatgaattccataaaaccaaagcaaactttatggcaatacgggaaagggagaatcttatgggatcagtacgaaaagatattgagtcatataaaagtgggtctggagtaaacaacagaagaactgagctatttttgaaagaacatgaccaccttcgaaactcagatcgtctgatagaagagacaataagcattgctatggcaacaaaagaaaatatgacttcacagagaggaatgttgaagtcaattcacagcaaaatgaacactttggccaatcgttttcctgctgtaaacagcctgatccagaggatcaacctgaggaagcggcgggactcgctcatcctagggggtgttattgggatctgtaccatcctgttgctgctgtatgcgttccattgatgggacatcttcagggactcttgacagccaccgctttcacaccctggtctggaataaggaaacatcggagggagaagttgactgtcttgataattagcctgaccagcaggatgaatgcaagactgacagtgatggactctgtgacatggtcaggttgagctgaagccacagtttctctgtgctgtgttttctaacacatttttctgtttttaattaaaaaaaaaaaaaaaaggttttcagttgcttttgtctccctaggaggcaggtaaaccaatcaaaaacagagttttctgtgtttccatgatagtgttgaagcctaatgacaagccaggtcttacagctgggctcttcagaaaaccaggtttctacatccaaagactgcttttcttttagctgccagattggattgtgaataaaaataattcttccctctccctctccctctccccacggtctccctctttccacggtctccctctgatgccgagccgaagctggactgtactgctgccatctcggctcactgcaacctccctgcctgattctcctgcctcagcctgccgagtgcctgcaattgcaggcgagcgccgccacgcctgactgcctcggcctcccgaggtgccgggattgcagacggagtctcgttcactcagtgctcaatggtgcccaggctggagtgcagtggcgtgatctcggctcactacaacctccacctcccagccacctgccttggcctcccaaagtgccgagattgcagcctctgcccggccgccaccccgtctggaaagtgaggagcgcctctgcccggccgccatcccatctaggaagtgaggagcgcctcttcccagccgccatcccatctaggaagtgaggagcgtctctgcccggccgcccatcgtctgagatgtggggagcgcctctgccccgccgccccgtctgggatgtgaggagctcctctgcccggccgcgaccccgtctgggaggtgaggagcgtctctgtctggccaccccgtctgagaagtgaggagacctccgcccggcagccgccctgtctgagaagtgaggagcccctccgcccggcagccaccccatctgggaagtgaggagcgtctacgcccgggcagctgccccgtccgggagggaggtgggggggtcagccccccgcccggccagccgccccgtccgggagggaggtgggggggatcagccccccgcccggccagccgccccgtccgggagggaggtggggggcgcctctgcccggccgcccctgcccggccgcccctactgggaagtgaggagcccctctgcctggccaccaccccatctgggaggtgtgcccagcagctcattgagaacgggccatgatgacaatggcggttttgtggaatagaaaaggcggaaaggtggggaaaagattgagaaattggatggttgccgtgtctgtgtagaaagaagtagacatgggagacttttcattttgttctgtactaagaaaaattcttctgccttgggatcctgttgatctatgaccttacccccaacctggtgctctctgaaacatgtgctgtgtccactcagggttaaatggattaagggtggtgcaagatgtgctttgttaaacagatgcttgaaggcagcatgctccttaagagtcatcaccactccctaatctcaagtacccagggacacaaacactgcggaaggcggcagggtcctctgcctaggaaaaccagagacctttgttcacttgttgatctgctgaccttccctccactattgtcctatgaccctgccaaatccccctctgcgagaaacacccaagaatgatcaattaaaaaaaaaataatataataataattcttgtcctcttattttacactcataatgagaaatcacaagttctttcttgatgatctgtgctatagatttctactctgtctcctcaactctgttgatatttggggaaaattctgtttttcatagattctttgagatgctgatggaccagcttcagcatgtttgaggttgtctgaaatggagatcactgtaaaactgtctttttcttttaaattacaagtacactggggttaactgtattgctggaaaaacatcaagaatgacagtcttatatttaaggcaccagtcattgtttccattttttttttaattcttcccttggattaatattttctactgaaaagaaatgaaatctcagttccactatgataaaagaaacgaatcaccagtgtctgtcagtgcccccactgctcctcctcataccagcattgacactggtagctgaggaaggggactgctcaatttctaatgtgatctattcaagaagccacatataaaaaggcattgagggctcactgtccagagaattgcttttgtaaatgctccacaacgtatgggcaaaagtttaaggactactgcctgatgtaccaggaatcctgagttctgtgaaaatctgttcattccaaatctgttaagcatttccaaacatccagagaatggtttcactgttgagggtgcatgtggcagaatctgtctctctctgcacctgtcttctgttaccatccctggacagtgacagattttaagccagccaccagaattcttttcgagttaaccatttcttagtttctgtaaattcatgacttgtcttactgaactacagcctggtttgtagacttccaacatctacactgctgctcttcaccattggaattcactgtggtatttatagtattggcttcagtccgagccacaggcaataaaaggatatcagctgtagttctcagctacatcatggtgtatagatgctgttattcaggcgaacttgctcatgggtggactaacacctggtttggtacagagactgagaagtttttcattctggtgtcaaagttttgttacattatgggtgtgaagggcatttgatatatttttcttaactatggggtttatttttctaaatgtgggttgattgactgttaattgattcagggtacccttaaaagaaaagaagttttcccattgtgaaccttaaatgatcagagaagtaagttcattgattaaattctctgttgggagaacaaaacttttctcccttgacactttattatctttgatttttcaaagggccttgattggtggttgtgtctcggttaaaatttatgggactttgctatgtagttggcatttataaaatctgaagtatcataaataaagttatttatttaattatactaccagtcttttttactggtctgattcttttgtgcattcattaaagctgattgtgtgagagtgaactgggacacaagctagtctagctcactgcagccaagcaaaccctgttgatggctgatgggcctttccattagggttttgcttatgtgaagtaatggaattatgttggttattttctttatgaaaataaaccagttcttccaaggaagttaaaaggcttggtatggatgttggtgtcagataggtctgactaacctctccgtgctgcagcctatactaaggtgacccagggccacatgtagacagctaggccagtgctttttcctcttagggtttctttgcagaaagaaacctccagcaagggaagagaggtgtgtgtccacaggaaggggctccgtggggatcccatgaagggatttgagctctttcagctccatgtcatttaacttttttgtttaaccaccttggctttctctccttttttgctgtcctccttacggaccagttaccagattcagaggctaacagttagttacttgttaatgctagtcacagccaggaggtcagaaggaattttctacttctggatccaaatgttacctcttaggggaagttatgccccctcaactattgtcttattataatgaatctttcctttttggtccttttaagtaaccactcaaaacttttcatttcactgaaaaaatatgaaaaaccatgacaatagggctgggtgcagtggctcacgcctgtaatcttagcactttgggagaccaaggcaggcggatcgtttgaggccaggagtttgagaccagcctgggcaatgtagcaagactctgtctctgcaaaaaaaattaaaagatacctgagagctcactttaatatcaaggtatttgcatccattcccaccctgttagctcttaagggaggagggaaatcaattccaaccatactttcctgtgatggaagatgtttcctcttgaaaaaatgccaatacagatttttaaaacctattgttttccaaatgcactttgtaagtttttgcttttaaaatagcttcttggaaccaattttattgtatttgtacttaatttttgttctcatctaaatgtgcattttctgactgtatagaagaagctttggtatgtaatttaataataaattagaaatctaaatgaaaaaa

SEQ ID NO: 63 - DNA, 1160 bp, Homo sapiens
gtgtgaagtaagcaatctattttcacttgctattaacagcaaacgtacaactttatctcttatttgacttcattatttggctttcaaattaacaacatgaaaactatacagaaattagtctgtgccctataagacagagatttagataatttgttcaaaacatgagatgatattcagatattctctcaaaggcaggactccaacaccgcaggtggaaaaccaacaaaaggaagaaaacagaaaggaggaaagggaagatgaaagaccgacttcaagaactaaagcagagaacaaaggaaattgaactctctagagacagtcatgtatcaactacagaaacagaggaacaaggggtgtttctacagcaagctgttatttatgaaagagagcctgtagctgagagacacctacatgaaatccaaaaactacaggaaagtattaacaatttggcagataatgttcaaaaatttgggcagcaacagaaaagtctggtggcttcaatgagaaggtttagtctacttaagagagagtctaccattacaaaggagataaaaattcaggcagaatacatcaacagaagtttgaatgatttagttaaagaagttaaaaagtcagaggttgaaaatggtccatcttcagtggtcacaaggatacttaaatctcagcatgctgcaatgttccgccattttcagcaaatcatgtttatatacaatgacacaatagcagcaaagcaagagaagtgcaagacatttattttacgtcagcttgaagttgctggaaaagagatgtctgaagaagatgtaaatgatatgcttcatcaaggaaaatgggaagtttttaatgaaagcttacttacagaaatcaatatcactaaagcacaactttcagagattgaacagagacacaaggaacttgttaatttggagaaccaaataaaggatttaagggatcttttcattcagatatctcttttagtagaggaacaaggagagagcatcaataatattgaaatgacagtgaatagtacaaaagagtatgttaacaatactaaagagaaatttggactagctgtaaaatacaaaaaaagaaatccttgcagagtactgtgttgttggtgctgtccatgctgtagctcaaaataaagaagctattttaaaaaa

SEQ ID NO: 64 - DNA, 4890 bp, Homo sapiens
gagctgcagtcagatccggggatggagggagccggagaagaggagtgagaaggccggggaggcaggccctgctgtcttcctgcaggccggcagcctgctggcagtggaggaccaggccgtccaggaaaggaaggggtcaggaggtcgggcagggcctcagcaggttcagacaagtccccagaagggagctgcaggcgccctcgagtccaggccccaagcctggctccggttgtccaaagagggcctaggccaggcctctggtgcggaaactgagtcacagccagacctcagggcacggcctagacgcttacgagccaaagttaggggtagagagcagagacctccggggggtctcagggagtagggggcttcagggcctcccagtctagagccggattggcgagttagacgcttgtagatccaaggttggattggggtggggtctctgggacgttggatcgctacgcaaggattggggggattcaagtgcttagagatcgaagtctgccctgggtagggggagtcagacaattggaaagcctaggtagttatttggggaggggtctctacgccttggcgaagcgcacagctgcatctttttggcttgaggcctgaggccttgtcgagaagcttccgtgaaagggtgggccagccgggccacgagaaagaaagtgaataaatcaggaatataagtgggcggggggcccctgagaggggggtcgcaaagggtgagacatggccaccaggcgtttaaccgacgctttcttgttgttgcggaataattccatccaaaaccggcagctgttagccgagcaacttgctgatgaccgtatggcactggtgtcaggcatcagcttagatccagaagcagcgattggtgtgacaaaacggccacctcctaagtgggtggatggagtggatgaaattcagtatgatgttggccggattaagcagaagatgaaagaattggccagccttcatgacaagcatttaaacagacccaccctggatgacagcagcgaagaggaacatgccattgagataactacccaagagatcactcagctcttccacaggtgccagcgtgccgtgcaggccctgccgagccgggcccgggcctgctccgagcaggaggggcggctgcttgggaacgtggtggcctcgctggcgcaggccctgcaggaactctccaccagcttccggcacgcacagtcaggctacctcaaacgcatgaagaatcgagaggaaagatcccagcattttttcgacacatcagtaccactaatggatgatggagacgataacactctttaccatcggggttttacagaggaccagttagttctggtggagcagaacacactgatggtggaagagcgggaacgagagattcgccagattgtacagtccatttctgacctgaatgaaatattcagggacttaggggcgatgattgtagaacagggtacagtccttgacagaattgactataacgttgaacagtcctgtatcaaaactgaagatggtttgaaacagcttcacaaggcagaacagtatcaaaagaagaatcggaagatgcttgtgattttaatattatttgtcatcatcattgtgctcattgttgtcctcgttggcgtgaagtctcgataagtggcattgggttttcgtgtgtgccgcgcgtgtggatctcccgggtgtgaggggcttggcctgcgccccgccagctgcccgcagaggtgcagcctcgaggaatctgagggcgtcggggcagcgaacctttgcatccacggactcctccttccctagtcctgctcaagcggtccggggaatgggtttttgtttttccttcattgttgagaatttaaggacctttgatactgctgcacaatagagattgagttctgggatcagttataatatatattttttttagaaagagaaaatgagctgagagtttacaggcactgcagaagctgttcagtattatatgtgtatatgctatttttttagcagccatgtctgagcagaatgttaacataatttttggaaaaattttctttaaaccatctggtttttaagaaatttggtaccaaaaattgatgagtagaggcaaaaatgccccttcatctttctctatatattttccagttgaaaacaaactaagaagtcctttaagaatttataatccgttccccattaacttaatttagcttttccatcactgttaatgatcagagtaacaaagtgtgaaaaataagaaaccatcattgatgttaattaacacatttagatgggccagttaaaacagcttcataagttttaaattaattgtaaatggaatattcctcatttaaaatttttgcactgcattttctactgtaaaccaaaagaggttactaagcaaaaccacctaaatttaagttggtgatttaaatgaatctcacattaaaagaaagcttgacagtgttatgaaagccaccagactcagccagtgtgtccccatgggtatccccagccatccttgctcaatccattacttatatactaactacataatgacctgttcaaaccagactctatttaatgaactgtgaatttacacagaggccattttaaatgggtcaccccatttaggattagtggatctcaaattattaaccaaacatcactccatttcaaagtaaaatattccaccagcgatttgatttattggctcttccattgccactgagcaatgcccaggaagcaggcacattgccaaggactgggggcatcttgactaggaagctcctcgtttgtgtgagcgtgggtcagaccgccaaagtaggacttcatcgtttacctacctattatcaatatggtgcttgaatatattcctataactgtagaacagtgtggaaagtgatggtaactttgaagttgttcatgttttattggctttgttttaattgacactagtagagttttaatggtctttgtgtaaattttaatggcttttccattgtttttgcttctcttaaaaagtttaagaagaatatgacctcattaaatgtgctgttttatttggaccagtcacacaaaatgtctctctagagttgactttaaagttgtttacagaaatttaaactcaattccagagattgaagttgtccaaacagctcatgggcttagtgtccaaacccctgcccagccttccctttccaagttggtgccacctccaggtagccattggtggttttcctattactgatgtggctgtggaatgataaggtcctagaggggccctggcatttcaggaagcggacctggtattccctgacaaacattgcttaggaaagagggccggagaataagaagccagcacctcatcagtcagccctgcaatgtgagacttccgtagctgttgagagtcactgcaggtgttctttcatcccatctgattttaacccatggttgagacgttccaagttagatctgctgctcttaggtgtggggctgtccacattagggaacttgcctcaaaaacagtccacagtggcaataccggacttctgttcaagctttttaaagtgctgagccttacaaacccctgaaggaaggtgaccctttaagagaggatcatctttttttatatttattttcaccaaatagggtgatgagggttggtttttgttccctcaacccatttgggtaaaataacggatctgattagaaactgttttaaggaggggctgggctcggtggctcacgcctgtaatcccagactttgagaggccaaggcggtcacgaggtcaggagttcgagaccagcctagccaacatggtgaaaccccgtctctacaaaaaatacaaaaattagccgggtgggacacgcctgtaatcccagctactcaagaggctgaggcaggagaatagcttgaacccgggaggcagaggttgcagtgagccgagatcacaccactgcactccagcctgggtgacagagcgaggctccgtctcaaaaaaaaaaaaaaaaaattgttttagcgctgggtttcccaaggtgggagagacagacccagcctggagctggcccctggcctgtgtgctgacttcttggggtcctcaaaccactgtatttttctgttgagcctgtacttggggagagatcagtagcatttgaggaagtaagagaaaagaatcatggtacctcagggtttctttccctttactcgctggcagccattgtctgtgggcacctcatgtttttccacactctactgggccgtggaggtaacgatcacccaggccagtctcctctgcctgggatgcgccctctgagaggaggcctagcagggcaggctccctctgggcatccctggatgcagcctctggacacatgcctcctttaaagtgtccgggtgcagctcaggttgagtggaggtagaaggagaaacagacatgtttaccacgcgttttccaaagctcctgatctttcccaagattgtaactgaaaactgctgtctcttgttttgttcgttttgggggtggtggtgctggctgggccatgcttgtgaagtgatgtgtgtctctgatttaacggattcactgttttctctgctaattgagagagcgttatttacattatttatttgttttgacacaagtgctttcagtgttttatcctagctaatggcttcttaaaggtaataaaacccttccaacgtaattggtcagataaaactttttttcttgtatgcttaaataaagcaattagtgaagcacttctatccaaaatgacttttttgtccttttttaaaaccaatttactgttactggaaactttttgtacaataaagcaatcacgcagattaaagaacatcctgcaatcctagtattaattttaaaaaaa

SEQ ID NO: 65 - DNA, 2210 bp, Homo sapiens
agtgacgtctttgccccgcgccgcgccgtcccacccatctccctggcctccggtcccaacttcgcttctctgctgaccctctctcgtcgccgctgccgccgccgcagctgccaaaatgtctacaggtccaactgctgccactggcagtaatcgaagacttcagcagacacaaaatcaagtagatgaggtggtggacataatgcgagttaacgtggacaaggttctggaaagagaccagaagctctctgagttagacgaccgtgcagacgcactgcaggcaggcgcttctcaatttgaaacgagcgcagccaagttgaagaggaaatattggtggaagaattgcaagatgtgggcaatcgggattactgttctggttatcttcatcatcatcatcatcgtgtgggttgtctcttcatgaagaaccagcggaactcaaaactgctgttcaagaaacctcttcaagacttttgacttagaacctgctatattatcaagcttacctactgttatctctaaaattttttttgtgttaatgtaaagttgaatttctaggaaacgtgcctttgttttttaatatgcactccaaattagaaggccggccccgtccacattttgcacagtgcctttacagatttacgtatgggctgatgaagaggccttcttaagttccagagtgctataatctagatgtaatgttgtcactaattaattgccattactcccagttagttacccttgtcatttggcattattttcagaaccacattttaaacctttgggtaatcagatttccaacttatgccttccagaaaaaaacactactgcctaacacaaatctgtgataacaacaggctgtgccttattttgataattttctgattccctagaagagaaccctctactttttgtaagcactactgactctcgctgtatttaagatgctggtgaagagcttttgctcttgcattagatttgaagatgtttacattgttgttattgttatgtatcacttgctaaaaatattgttttaatcagagataacctctttaaaaaaatttttaaagaactatggctatgaccaaagcttctattttgccaaaaagttaaataccgataaaatggccttaagtgtattcctgacagttaaattcagaaacgtgccaaatggaactcaaggtgccccttcagaattaaaatcattaccttgtgtgtgaaccttctacatcttcataggcctttcttccttttgaaaggctgtagacagtgtggctccccttctgattcagtattttgcatgggggttagagaaggtttgaggtagactctgaccgtctcataaaagagttctacccagcagttggcagattatcagctgtggactccagcatgtttctgataattatgcaagcaacaattctgtagcctcaagtaagaccacctgtgaacttgatcattatctggcccaaatatgaagataaactataactttggagtttgtttcctatttgtattcacattctgcttcctaaatcagttttctaaattatgcctgcaattaggcattggtcaggggtgaatggctcttttcacagagagtagccaaccagagacctttgctttgatatcatcaactgcagagaatgctgttgatgggaatgctggaagcagaaactttgtcatcggaaaaacttttcttgtatgcatgagactcaacatcaggatccacagcttaaagatgggaattcaggtatgaaagaaaacaggcaaggaggcactgagggagaaagacacagactttatcgctctgtggctcattgttactggaatattctaaaactcttgttcacatgctattatgacttataaagcagcaacagctgaggcgcaccaggacacagcttccatttctttaacgtctgttcccttaacatcgctgaaatgatttactgttgaagagatgccttgcggtgtggccagctgtgaggagaaagcagctggcagtgttaggacattagtccaccttcagcgcagggtctctggccgggtctgactcagaaaccttggtactcgccccttggccacagtgcccagacccatgtaacccactggctcctgcattaacccagaaatacctcgcttctatctgtgcacttagctgggaacttacccactgtaatcacctaaataaagtgtttataaacatgaaaaaa

SEQ ID NO: 66 - DNA, 3140 bp, Homo sapiens
agtaagttccagcgcagctagaccgcggggtagtcggcgcgaggcggagcttggcagttccgtccacttcagccgcagcgtccctcgccgggtgtctcgccgcagcctccggagaggaacagaccctcactctctctgtcagaaaaatgtctgctccagctcagccacctgctgaagggacagaagggactgccccaggtgggggtccccctggccctcctcctaacatgaccagtaacagacgactacagcaaacccaggcacaagtggaggaggtggtggacatcatacgtgtgaacgtggacaaggtcctggagagggaccagaagctgtcagagctggatgaccgagctgatgccttgcaggcaggagcatcacaatttgagagcagtgctgccaagctaaagaggaagtattggtggaaaaactgcaagatgatgatcatgctgggagccatctgtgccatcatcgtggtagttattgtaagtaagtatcgctgaagttgctggtggggtgaagaggtgggaaggtcctggagtcttctccctgcctgcctgcctgcctggggagtggggctgctctgactgaggtatggagaccgctgctatgggatcgtcacctggttcgggacgggggaagggcagagacaagggatttctttgatggacaagccttccccctgcaacgcattgcagggagatggcgcctcctgttctgaggaagtggggctatgctgtgtgtcactggcttgggttggagggagaccatggggatggggcacttaacaatggagagacctgaatgtctggtaacttggtgtaattcaccctcttgttttctcctgtctctttctcttttccgtctgggacttcctgattcctgtgtccagtctacttttttacttgagaatgtaccaccccttccctgttgtccattgccatccacattcatgtcctctgccctctgtttgctctctcaacacacttccccacccaccgtcctccattccagcccaggcttctccatcacccattcctcctttttcgttgcgttcatttgcactctgtccctcaacactagaaatgctgctcgtggcacaatctaagtcattacccgaagagcaacagctggcgcctcctccctgcctgctttttctgtactctcaagttcccccaaagccccaaagagttggaggccaagggaaggggcagggaggggagtggctgaggcgaagtacccatgaagctgcccagacttgggaggagaagagtatcggtgcccatggtgacttctagaaaacctggccactggtaggagctagggaggggctgggaagatggcagctcactcagtactgcctggtcatgtggagctttccttcctggaccaggcctggagagggtcctgggggtggaccaaagtccaacttggtttcagtgcagtacccttttcgaaagtaaaaacttgttttttgtagttatttctaatctgttcgtccaggattttccgtgtctttggggatcttacaactttactttgttctccagaggcctggagaacacttagggattgtgaaaatagcaggacttgtttccatcctagaagcagtcccatgtgcttctagctggaaggagctttctcttctttacattttctacagcattctgtatgagggcaccaaataaatccatctagctggtagttttatctagccaaataatttaacctagctcccagttaattgttggcataaagagagagattgcctgttagttatagagaaacagtgagtcaagtgcttaatttgaaagtaacaagctcagaggaagccactccttgccctcgttaaagagggtcctgttcctctcttcctgttgatgaaggagcgtgagggtgttagcagtgtgagatctttggacacccatggaatcctttcctccacaccacccgtgcacttgccaaagacagggatgaggcaagtggttcttcctggggcccggccgatcctcaggatgcagagaagtcatgtagacccaccagccccaccttggggggaggcgtgccagcctgtgtcaggtgtgcttgtgtattgctgtgctgtcatggggccctctccttgagagccgcctctctgttcttcctgtagtatattcccctttgaaccaccctttcctgtctgaattctactttgcctcctttctcttcctcctctttgcatggtttgtgtgtatagacagtggaacctgaggatgggatctgctcagcctatcttcggggcaattgctgagcttcaggatgggctattaatgtgggataagcccaggtgcaaggggaggagggcaggctgggaacagagcggagaatgcccatggccctttattccttcttccctcggtccacgaacaggaagaggctgaggccatgctgggcagggtctggatgcccactttccatgcagcagcatttcattgctcaaaaccatccttcctttcctttcgcccttgtttcccacattcccttcgtcctgcccaagggcgggactgaagagctggaagaaagcagtcagtaccctcccaacggcccccctcgaaggtctccactctcctctgggctcctccttgcctaatgcagggggtcaccgctggagaagaaccaccactgtcctcgatgtgtcccaagcctggagcgaatccgtcctcttggctctcccagccctatcacaggaatcattcctgggtttctgtccctctgaggctcaccaggtgtagttggccttgttctttgggggtattagcccttctactttctttctcacccaccctgtaccctcttctgtgtgtctctgctatccccctttcctcccaccacccatgtgcatgagcaaatgtgcaacaaaaccctgggactttgcagtcaaatgaagctgagcttcccacatcccgttcttcggtttgccatgagacgatgtggggtttccactgtgtgtctgtcatcacctctttgtctttttttcctaaccctgatctcatacttgtatagagtaataacaacagttgtacttccaccaaaggcatgtggcatatttaccaatgtcatgtattctgaacaaaggcaaaaaatacaaattcctaccattaaaa

SEQ ID NO: 67 - DNA, 1090 bp, Homo sapiens
agtaagttccagcgcagctagaccgcggggtagtcggcgcgaggcggagcttggcagttccgtccacttcagccgcagcgtccctcgccgggtgtctcgccgcagcctccggagaggaacagaccctcactctctctgtcagaaaaatgtctgctccagctcagccacctgctgaagggacagaagggactgccccaggtgggggtccccctggccctcctcctaacatgaccagtaacagacgactacagcaaacccaggcacaagtggaggaggtggtggacatcatacgtgtgaacgtggacaaggtcctggagagggaccagaagctgtcagagctggatgaccgagctgatgccttgcaggcaggagcatcacaatttgagagcagtgctgccaagctaaagaggaagtattggtggaaaaactgcaagatgatgatcatgctgggagccatctgtgccatcatcgtggtagttattgtaaggcgggactgaagagctggaagaaagcagtcagtaccctcccaacggcccccctcgaaggtctccactctcctctgggctcctccttgcctaatgcagggggtcaccgctggagaagaaccaccactgtcctcgatgtgtcccaagcctggagcgaatccgtcctcttggctctcccagccctatcacaggaatcattcctgggtttctgtccctctgaggctcaccaggtgtagttggccttgttctttgggggtattagcccttctactttctttctcacccaccctgtaccctcttctgtgtgtctctgctatccccctttcctcccaccacccatgtgcatgagcaaatgtgcaacaaaaccctgggactttgcagtcaaatgaagctgagcttcccacatcccgttcttcggtttgccatgagacgatgtggggtttccactgtgtgtctgtcatcacctctttgtctttttttcctaaccctgatctcatacttgtatagagtaataacaacagttgtacttccaccaaaggcatgtggcatatttaccaatgtcatgtattctgaacaaaggcaaaaaatacaaattcctaccatta

SEQ ID NO: 68 - DNA, 5000 bp, Homo sapiens
cagctagccgcctcctgcaggggctcgggagagcaattcggcggcccctgcagggcagctgaagccatggaagcctccgcaggtcgctgatcagggccaggcggctgcagcagcgactgcagaggcgctgcgccaagccgggccggagtggtgcgagccggcggggctgcggagggccagtggactcagcccccgggataccgcccatcccaccccttactcggacccacagcctcatggccatgtccctgccaggaagtagacggacctctgctggatcacgcaggcgcacctctccacctgtgagcgtgcgggatgcctacggcacctcttcgctcagcagcagcagcaattctggctcctacaagggcagtgacagcagtcccacgccaaggcgctccatgaaatacacgctgtgcagtgacaaccatggcatcaagcccccgaccccggagcagtacctgacccccctgcagcagaaggaggtgtgcatccggcacctgaaagcccggctgaaggacacacaggaccggctccaggaccgggacacagagattgatgacctgaagacgcagctgtcacgcatgcaggaggactggattgaggaggagtgccaccgcgtggaggcccagctggccctgaaggaggcccgaaaggagatcaagcagctcaagcaggtcatcgacactgtcaagaacaacctgattgacaaggacaaggggctgcagaagtacttcgtggacatcaacatccagaacaagaagctggagacgctgctgcacagcatggaggtggcccagaatggcatggccaaggaggatggcactggggagtcagccggtgggtcccctgcccgctccctcacccgcagctccacctacaccaagctgagtgacccggctgtctgtggtgaccgccagccgggtgatccctccagcggctctgctgaggatggggcagacagtggctttgcagcagccgatgacacactgagccggacggacgcgctggaagccagcagcctgctgtcgtcgggggtggactgtggcaccgaggagacctcgctgcacagctccttcggcctgggcccccgcttccctgccagcaacacctatgagaagctgctgtgtggcatggaggctggtgtgcaggccagctgcatgcaggagcgtgccatccagacagacttcgtgcagtaccagcctgaccttgacaccatcctggagaaagtgacccaggcccaggtctgtgggacagaccctgagtcaggggacaggtgcccagagctggatgcccacccttcagggcccagagaccccaactcagcagtggtggtgacagtgggtgatgagctagaggccccagagcccatcacccgtggacccaccccacagcggcctggtgccaaccccaaccctggccagtcggtgagcgtggtgtgccccatggaagaggaggaggaggctgccgtggctgagaaggagcccaagagctactggagccgccactacatcgtggatctgctggctgtggtggtgccggccgtgcccacggtggcctggctttgccgctcccagcggcgccagggccagcccatctacaacatcagctccctgctgcggggctgctgcactgtggccttgcactccatccgcaggatcagctgccgctcgctgagccagccgagtcccagcccagcgggcggcggctcccagctctgagggggcccattccggcagcggcgcctgcggcctgaccactgattgtagggatgccgttcccccctcccttctcccatgggcatcatcttatttatttagttttgggtgtggaactgtttctttttttcaagatgttaaaacagtcccgtggaaggagcaggggttggagaaaggcatcccaaagcttcgatggagagcagggaagggggacccaaggcaggaggtacaccagctggacaaattgcagggaggggagggagcgagggccaacccggcccctctgtccccttggctcttcagacagggccagccctgctcaggaagtctctggctgtcttcatgtggggaagccgggcttgagttgcccataggcccctgccctgcaccatcctgtccagtgccctgcgcactccatgccgtctcttccaagccaccttgcccgcagcccaggctcctgggccagtgctctctcctcaaatggaggcagccatggcctgaagtgcagatcactgacccagggctcagagcagaggccagaaccactgggccggccggcattccagcctccccagactgctgcccaccttgggactcaggagctcagtcaaggccacaggctggaggagagacggggctgggcgcaaggtggcggagggcagtgtgggttctgtgtctgtctgttcatcccaggctttcccgtcatccctttcctcttggcacttctgggtgtgtcagtcattattcctgtgaggtagctaagcccggcaagctcagtgctggggtaggagggcctgcctgagtcccagctcccagctggagaatccaccagcacaagaagaggaggcaggggcagaaacccaagggggctcccccagccttccaaggtgaggccatctcatctgcaggctgggaggcagggctggactcaggaacccacagcttactgaaaaagccagaggccatgactgcccccagaaacttgccccgagtttctctggggccctcgggcccaacttctgctttgcactatgttcactttggggttggttctcagccatccaagggtctccagtgaggtggctgcttgctgtctgagatgagggttcctaaaccttaaacctctctgcctctggaggagggtggggtattctggcaggatgaatcgcaggatggcgcgtactgaagccacgatgttcatccaggccaaagcagggtgtcctgggataggtttcctaggcaggggcgtggcagagcaggtaggcgccctgcagcctccctgctcccagcccaaggccagtcggcctgggaagttcactgccccaactcttttcccgggaccatactgagtcccccagccacgctgctgacattaccattattattttaccaagtaaactcactccttttcccccacaggggttacacccatctggttgtcccacccactcttcagaggctaggccccacctctgggggttggagggaccctgtgtcttactcgcccctctggcctaagggccactctggttatctgccaaggttgcttgccctcaccccaatgctccaacagccattgcctaactcatgggctctgcccttctgctcggtgccctccacgtgaggcggggcacctgcatgcactgggagggggcggctggcccagccctcggggcaggagccccctctgccacacgctttgtgcctccaaagctccccccgccttggtcagggcctcagaccagccaacctttgtggaataagccccagcccagccaaaccaaacccagatgcctgaggcctggctggggctgcccccgcaggacactgtggccatgccacggagggggcagtggacaaaaccaatccaaagccaagccgggactggctgcggacccagcctcctgtgccgcgcactcacggagctgcgtagtctcctcagacatagtcaaagctttgccgagaaaagaaatgtatgaactatatttgacaacataaaatctctctatttttcaccactggaatttagtcaagcttcaggcccctctgctcctgtctgtgtcttgcgtctgtggccttcctattgtgtcttgtgttttggtggatgtgacagggctggggccacagtctactctgtctctgctgctagagaagccacctgtggaggactgggctgtggttgggcctgaggcctgtggaggaggtgagtgtagccagcagcggccgtctactcctgttctggcctgagaccaccggtgtgggtcacgagggccctggcccacagtgttgagggtcctctctttcgggggctctcctggggccttcgatgggcttttcttcttgtcagtggagggagcagctccccactcagccctgggacaggccctgggactgtggtggccggtggccctggcccagctctggagtgcatgtgtgtgtgctcagatcccgcatctatgcaaaggtgcaggctgcctgtgaggctccaggcggtggaggtgcggcagctgctgctcaggtgccatgccctgaagaggcagggtacacatggggctgggagggcaaagatggggcggggcctccccctgagagagctcaccctccacagtgacccttttccttcctgcctaatacctcctcccgttgggctgtgacttttcctcctgccctcagcctctgaaacagaaatctttggggcctcccctttccccagcgtctggcaagagctgatgaggtcctgaggaacagtgtccccaggaaccaccttctggagcctagcggccagacgtggcttctcctgagttctagggctcgggccagagtggcactactgcccggccagtccaggctcaggcaggaatcggacgctggggcccgggctctgcacagagagctgggcttgagtggagtttattgtagatttctcccaaggggatcacttagcttctcactgacacacccttcccaattgccacaagcgcaggggtatcttacagcactttggggaggggtgggacaaactgcaaggttctggggccaaggcctacccaggggcctctgcccagagaactcacaaccccctctctgacctaggggacaatgcaaacaggtcacagtgcattcccatattaggccatccccttcacgaagaattcaggggatgtgggaagtggggaggcggggagggatcttgactcttgtctcctttgtccttttgttcagacagagttgtacctgcagcagacaactctgaattaaagcatgaaaacacagcaaaaaaaa

SEQ ID NO: 69 - DNA, 2770 bp, Homo sapiens
gattgcgagccaggaggaggaagccggcggtggccccgtcagcagccggctgctgagaggccggtaggcggcggcggtcccgaggggcggcggccgcgctgctccctgagaacgggtcccgcagctgggcaggcgggcggcctgagggcgcggagccatgaagctgtacagcctcagcgtcctctacaaaggcgaggccaaggtggtgctgctcaaagccgcatacgatgtgtcttccttcagctttttccagagatccagcgttcaggaattcatgaccttcacgagtcaactgattgtggagcgctcatcgaaaggcactagagcttctgtcaaagaacaagactatctgtgccacgtctacgtccggaatgatagtcttgcaggtgtggtcattgctgacaatgaatacccatcccgggtggcctttaccttgctggagaaggtactagatgaattctccaagcaagtcgacaggatagactggccagtaggatcccctgctacaatccattacccagccctggatggtcacctcagtagataccagaacccacgagaagctgatcccatgactaaagtgcaggccgaactagatgagaccaaaatcattctgcacaacaccatggagtctctgttagagcgaggtgagaagctagatgacttggtgtccaaatccgaggtgctgggaacacagtctaaagccttctataaaactgcccggaaacaaaactcatgctgtgccatcatgtgatgcagcctgccagaggcccaatgctggaatggcaccatcattcacatcagaactgcagcccctggaaaagaagagacagccatagacgaggagccagagtgggggcagactggccatttttattttgaagttcctgcgagaaatggatggtggaagggtggcgaatgttcaaattcatatgtgtggtagtgattcttggaaagaatttgaggtccccaaaggtgtatttttgggcaaatgaaaccataaactccgactggcttctgtagatgccaaagggctctttttcagctaaccctgggaaggctctgtgggagggaggtcggagccagctgtttctcgatctttggtatatctttggatcttatttgtacattaatgatattaacactccagtggggggtggggagtccctgatgctagggctggggtgggtggagtttgaagactcttgggaaagcctctcctggggccactgttgggggtgggagtgagcccaccacagaggccacaggcaggcccccacttcaggcccaaggcctggggcggggggaacagtcactgggtctcagattctgagactgttgtttagcttacctttctgctaggattggcttcccgcagagggcagggcccatcctaagcagcttccaagtcccacaaaggtggcttgtgggaggatttggaaggagctgcattgtgggcggggagtgtgtgggttgggttcgtaccagcaagtagactaggaactgagcccaggaaagggggatgttttcctggtgtttggatggtcagctgggagtgtccatcatcaggggaagatcaaacacaggtgcactcagctgcccagggcctctgggacacttgccttgacttgcaacttgccttgaacatcacgatcaaagcagcaggtgctgtggtctctcaaaattgatttttatttgactctgtggctctaagactgccttgaaccgcctgaggcctatgcatctgaacaagtgggtctctcccttgagcaccaggagtgggtgccagccggccccgaggattcccagcaccccacctatggtcttgccagcataggcttgctagttccttcttggtcagaggtagctgcagaggggggaggccaagggtttggtctaagctgtgccctgccacctggcaggaggcccactcactgcccaagtcatggcaacaggctggagcagcccaggagatgggcctaaaatgttctggatcccttgggtcctagtgttatgttccagtctgcccacctgtgctcaggatgcagccctgggatccagcacccatggaagcttctgctgggatggtgtcacctatgggttttgaaccagtgtggtatggtccttgggagctctgctctgagcttgccacactgctgagagcacccactgtcctgaccagagtctcagtggtcctgacccccaatgtgggcaggggctgggcaggagggtggggtctgctgtgggttcagaggactccacctcctggctggtttacctgctgctgcccattttctctgggtactgctggccagaggactttagcctacccctgaagagcctgtccatgtcattttcctactgccatagataccctaagcccagggccccttgaggcccagactcagcctgcccactggtgccggagacggagtggagtgggcctggatccgagggatgctacctctccctttcccacttgaggaccctggggagagatgggggcggggaaaatggaggtatgaatttggggtaagaggaagtgagatctccgcttgcaggtcagcccctgccttgcagggcgggctggcttgactcaggccctgtgagatagagggcccagcccagccccacccacagatcccctgctcctgttgtgttctgttgtaaatcatttggcgagactgtattttagtaactgctgcctaacttccctgtgttctatttgagaggcgcctgtctggataaagttgtcttgaaatttcaaaaa

SEQ ID NO: 70 - DNA, 1390 bp, Homo sapiens
gggaagaaaagggaattccaacctgtggaaccttggggggtccccggggtcggcgccttcccattgactgtgggcggtgcaagggacggagcctctggcggctcgtgggggtgttggggtccgcagggggagggaggggagtgtcagagtgtgagcggggtacgggaattccaaatttgagggcctcccggctctggcgccggggagggagagctcaggccgccatgcgggacaggacccacgagctgagacagggggatgacagctcggacgaagaggacaaggagcgggtcgcgctggtggtgcacccgggcacggcacggctggggagcccggacgaggagttcttccacaaggtccggacaattcggcagactattgtcaaactggggaataaagtccaggagttggagaaacagcaggtcaccatcctggccacgccccttcccgaggagagcatgaagcaggagctgcagaacctgcgcgatgagatcaaacagctggggagggagatccgcctgcagctgaaggccatagagccccagaaggaggaagctgatgagaactataactccgtcaacacaagaatgagaaaaacccagcatggggtcctgtcccagcaattcgtggagctcatcaacaagtgcaattcaatgcagtccgaataccgggagaagaacgtggagcggattcggaggcagctgaagatcaccaatgctgggatggtgtctgatgaggagttggagcagatgctggacagtgggcaaagcgaggtgtttgtgtccaatatcctgaaggacacgcaggtgactcgacaggccttaaatgagatctcggcccggcacagtgagatccagcagcttgaacgcagtattcgtgagctgcacgacatattcacttttctggctaccgaagtggagatgcagggggagatgatcaatcggattgagaagaacatcctgagctcagcggactacgtggaacgtgggcaggagcacgtcaagacggccctggagaaccagaagaaggcgaggaagaagaaagtcttgattgccatctgtgtgtccatcaccgtcgtcctcctagcagtcatcattggcgtcacagtggttggataatgtcgcacattgttggcactaggagcaccaggaacccagggcctggccttctctcccagcagcctggggggcagggcagagcctccagtcggaccccttcctcacactggcccctatgcagaagggcagacagttcttctggggttggcagctgctcattcatgatggcctcctccttcaggcctcaatgcctgggggaggcctgcactgtcctgattggccgggacacacggttttgtaaaaaattaaaaaacaaaaaaagagcataaaaa

SEQ ID NO: 71 - DNA, 1920 bp, Homo sapiens
ggcgcggagctcgggcggccgtggaggaactcagcctcggccgcaggaggcgccgggagcggagccgccgggagtcgcgcaacaggtttccttctccatcgctgcgcccacaggggacgcgcgccctgccgggagaggggcttctcggttcgcactctcgctcccagtccaggcaaaatgaaagaccggctagcagaacttctggacttgtccaagcaatatgaccagcagttcccagacggggacgatgagtttgactcgccccacgaggacatcgtgttcgagacggaccacatcctggagtccctgtaccgagacatccgggacattcaggatgaaaaccagctgctggtggccgacgtgaagcggctgggaaagcagaacgcccgcttcctcacgtccatgcggcgcctcagcagcatcaagcgcgacaccaactccatcgccaaggccatcaaggcccggggcgaggtcatccactgcaagctgcgcgccatgaaggagctgagcgaggcggctgaggcccagcacggcccgcactcggcagtggcgcgcatttcgcgggcgcagtacaacgcgctcaccctcaccttccagcgcgccatgcacgactacaaccaggccgagatgaagcagcgcgacaactgcaagatccgcatccagcgccagctggagatcatgggcaaggaagtctcgggcgaccagatcgaggacatgttcgagcagggtaagtgggacgtgttttccgagaacttgctggccgacgtgaagggcgcgcgggccgccctcaacgagatcgagagccgccaccgcgaactgctgcgcctggagagccgcatccgcgacgtacacgagctcttcttgcagatggcggtgctggtggagaagcaggccgacaccctgaacgtcatcgagctcaacgtacaaaagacggtcgactacaccggccaggccaaggcgcaggtgcggaaggccgtgcagtacgaggagaagaacccctgccggaccctctgctgcttctgctgtccctgcctcaagtagcaggccggcccgggccgccaccgcccatcccagaccatggagcgcgctgggaaggacgcaccaaagccgggagctctgccctgcagggagttgccccaaccctttccggaactcagtctttagaaaagaaacgccaggttcaagaattgcaaaccagcctgtgcttggaaagatggttagttgataccgtccgatgattcttcagtaaagatagattcccacaaagttgtgcaatgtcattatatgacaccttgcactcttaccgtcttgacagaagccaagtaaggaactgaagttgtatctgactgtagggtgaatgtctgaggcctgcctcctaataaagactcaaggaggaagtcaattgggcatctgctaatagaatgaactcatgatggaaacttcagttcatttactttgtcctgaaaattccctggttctgttccattttgagcgaaattggccttgggaaaaaccacgttcttcctttccgattcttcatccggtctacgctatgcaattcctccccaaatatagatcttatttctgctcatttcccctacttattaaaatcacaccaaacacttactattttcttatctctttcactttttaaatatctttcaccaggttatattttggtattatttttccaaacatttttaagcactgaatatcgaacaagcactcaaattgaagtatcagtcatgttttgtgtatttttcgctgataaaaattatttaacatttatatttttacttgattacatatgcacatgtatgtaaatgtaaaatactaatattcactaatatatgtacataatgatcaattggtttaacttcttttatgtaagtatggtatataaatttcaagacgaaaaaa

SEQ ID NO: 72 - DNA, 1912 bp, Homo sapiens
gatgtttgggtgcccgccccgcccgcctcgcccgccgtgagcgcccggagcggtccgcgagccaccgaggcccagctcagtgtggaggctgctggccctgccatctgtaagaagatgtcatacggatccatcgcccgtggaggtggcctggggagccgtggccctctcgggggaccttcgagacaaggctgtcagcccctagagtgcgctagatgttggaccgagtatggaatccgccatttcccctgcccgtcgccagagagcaagctgcagaacccctgtgtggggaaggacggggaaggtgatctggggccagcaggcacgcctattgtcccaagggccaggaagcgagggcctggggttgcccctgaaggcagccggatgccggagcccacctcatcacccaccattggcccgaggaaggactcggctgctgggccccatggccggatggcggggcccagcgctacccgggccaagaagaggaagcccaacttctgcccgcaggagaccgaggtgctggtgtccaaggtgagcaagcaccaccagctgctgtttggcacggggctgctgaaggccgagcccactcgcaggtaccgcgtgtggagccgcatcctgcaggccgtgaatgcgctgggctactgtcgccgcgacgttgtggacctgaagcacaagtggcgggacctacgagccgtcgtgcggcgcaagctgggcgacctccggaaggcggcccatggccccagccctggttccggcaagccccaggccctggctctcacgcccgtggagcaggtggtggccaagaccttctcttgccaggccctgccctccgagggcttcagtctggagccgcccagagccacccaggtcgatccgtgcaacctccaggagctgttccaggagatgtcggccaacgtcttccgaatcaactccagtgtgacctccttggagcggagccttcagtccttagggacaccgagtgacacgcaggagcttcgggacagcctgcacacggcacagcaggagaccaacaagaccattgcagccagcgccagctccgtgaagcagatggccgagctgctgcgcagctcctgcccgcaggagcgtctgcagcaggagcgtcctcagctggaccggctgaaaacccagctctcagatgccattcagtgctatggagtggtgcagaagaaaattgcagaaaagtccagagcgctgcttcccatggcgcagaggggcagtaaacagagtccccaggccccgtttgccgagctggctgatgatgagaaggtctttaacgggagtgacaacatgtggcagggccaggagcaggcgctgctcccggacatcactgaagaggacctggaggccatccggctgcgggaggaggccatcctgcagatggagagcaacttgctggatgtgaatcagatcatcaaggacttggcctccatggtgtcagagcaaggagaagctgttgatagtattgaagccagccttgaggctgcgtcctcgcatgcggaggcagcccgccagctcctggctggagccagccggcaccaactccagagacacaagatcaagtgctgcttcctatcagctggagtcactgccctgcttgtcatcatcatcatcatcgccacctctgtccgaaagtgatgctacccgtgcatcggccgctgaaccgtcagctggctgtggtgtgggctctccagccccgagcacccctcctggcccggagctgggagctgatggagtccgctgcgttgtcagctgatgccgtcacctggcctgcaatggacccgagagcttcacagctgcctgctgtcctcccctgcactgaccccactcgcccctgtgtcggccccagctgagcacccgaataaaccgctgtggcttatccaaaaaaaaaaag

SEQ ID NO: 73 - DNA, 2307 bp, Homo sapiens
cgcgactagggtgcagcgccaggtccggtgttggggtgtccgagttgccgccggagaggagtggcctcgcccgcttgagttttgattcatcatggataatctgtcatcagaagaaattcaacagagagctcaccagattactgatgagtctctggaaagtacgaggagaatcctgggtttagccattgagtctcaggatgcaggaatcaagaccatcactatgctggatgaacaaaaggaacaactaaaccgcatagaagaaggcttggaccaaataaataaggacatgagagagacagagaagactttaacagaactcaacaaatgctgtggcctttgtgtctgcccatgtaatagaacaaagaactttgagtctggcaaggcttataagacaacatggggagatggtggagaaaactcaccttgcaatgtagtatctaaacagccaggcccggtgacaaatggtcagcttcagcaaccaacaacgggagcagccagtggtggatacattaaacgcataactaatgatgccagagaagatgaaatggaagagaacctgactcaagtgggcagtatcctgggaaatctaaaagacatggccctgaacataggcaatgagattgatgctcaaaatccacaaataaaacgaatcacagacaaggctgacaccaacagagatcgtattgatattgccaatgccagagcaaagaaactcattgacagctaaagctactgctgttcttctttatcatttattcacttccgtagctcctccttgaaagttattaccttttcagagtttaagttttcggttccacgctcttctaattgggagataatatggaagaagggccagagcagttacagccctccttcttttttgttttctgttgagggccgactgctgctctgccttccttctagtattttctttctcaattcatacgcttagattggttttcatatgtcatgtttagtgttttcatcctcctcatatacttcagcaggttcttttgctttcaagatttggaagcattgccaaagacagccatgaagaaggaagctgtagaggtgttttttgttgttgtttatttttgcttttgtggttgagggaaggacaagagataagaggttgttacctcagtaaaaaccttcaggccacaaagcaaaaagttgcatagccacaacgaagatctagttggatatagtttttgatttaagttgcagttatagccaatttaggctaatgcttggttttggagcttttatacacaacgtttttgttaggcatcacagttttgcaacctctgctccaaagagaaaaatagaatgagttttctttcttttttttttttttggagtcagagtctcgctctcttgtccaggctggagtgcaatagcgcgatctgggctcactgcaacctccgcctccctggttcaagcaattctcctgccttgcctcctgagtagctgggattacaggcgtgtgtcaccacgctcggctaatttttgtatttttagtagagacagggtttcaccatgtcaagctggtcttggactcctgacgtcgtgatccacccgccttggcctcccaaagtactgggattacaggcgtgagccactgtgcctggctgagttttcttaaagtgagcttaatttctgaactcttagtgattcatatatgtacataaatctgtgatcccatttcttattgcaccattcaggaacactttatataaatgagtggctttttatttcatattattagtagtatcatggttccattacaggcctattaacatcatacattgtcattagtctttgaagaaaaaatatgtaaatatatatgtgtaacatgagaatttctctctaaagcagggcttaaaattttttggaaaagtttgacaaagcataccacatgaattcagatttacctcaatgctaagaattatgtttagttaggaaaaaggaaagtcattttgacctcaggtagaaaaatagattgctttgagttttatgtagctttagactttaaaaagttagaatttattctgtaactaaaaattatttgaaaaaattatgcctctggtttaattattggtgattacacactctttctcttacccttgtgtattgaactatgtccataatcaagttgatgtggatcctgaaaagtgttatgaacatctgattggtatttgtcacatttattttaaaattagcatctgaacacttcaaagctgtcagtgtgtattggtttcaccaataaccactgcttgatccttacaattaaattttttaactaac

SEQ ID NO: 74 - DNA, 2920 bp, Homo sapiens
actctatgtctcctctcgttggattgtgacaccgggaggtcagggaactccaggaccttgttctctgctggattcgcagcaaccagcacagcacgtagggcgtagttggtgctggatggatgtttgttgaatgaatgaatgatgaatggctggcaccttgtctgctcatccctaactcctgttccttcatctgtgcagccctaatctttgtttcctcatctgtccatccctttatttgtgcatcctcattcttagccccttcactgcccttctccatctcttcctccttgttcatttgtccctgttctctgtcctctactccactcatgcccatctctgtccccttgacttacccagtccctgctactatctccatccctaatttctgccctcttgtctgtctactcctaattccttttccttgtccatccctaatacctgtcaccttgtccttcttcctcgaatctccatccctaatccatctgcccctaatctctgtcccctttgcccatccttccttttctcggtgtctctttccacccttatctccacacctgcccaccctgcactcccattctgtttcccatctgcacccttgccccatccctcccacacacaggaccagacggccaccatgtcaggagactacgaggatgacctctgccggcgggcactcatcctggtctcggacctctgtgcgcgggtccgagatgctgacaccaacgacaggtgccaggagttcaatgaccgaatccgaggctatccccggggtccagatgcagacatctccgtgagcctgctgtcggtcatcgtgacattctgtggcattgtccttctgggtgtctctctcttcgtgtcctggaagttgtgctgggtgccctggcgggacaagggaggctcggcagtgggcggtggccccctgcgcaaagacctaggccctggtgtcgggctggcaggcctggtaggcggaggcgggcaccacctggcggctggcctgggtggccatcctctgctgggcggcccacaccaccatgcccatgccgcccaccatccaccctttgctgagctgctggagccaggcagcctggggggttctgacacccctgagccctcctacttggacatggactcgtatccagaggctgcagcagcagcagtggccgctggggtcaaaccgagccaaacatcccctgagctgccctctgaggggggagcaggctctgggttgctcctgctgccccccagtggtgggggcttgcccagtgcccagtcacatcagcaggtcacaagcctggcacccactaccaggtacccagccctgccccgacccctcacccagcagactctgacctcccagccggaccccagcagtgaggagcgcccacctgccctgcccttacccctgcctggaggcgaggaaaaagccaaactcattgggcagattaagccagagctgtaccaggggactggccctggtggccggcggagcggtgggggcccaggctctggagaggcaggcacaggggcaccctgtggccgtatcagcttcgccctgcggtacctctatggctcggaccagctggtggtgaggatcctgcaggccctggacctccctgccaaggactccaacggcttctcagacccctacgtcaagatctacctgctgcctgaccgcaagaaaaagtttcagaccaaggtgcacaggaagaccctgaaccccgtcttcaatgagacgtttcaattctcggtgcccctggccgagctggcccaacgcaaactgcacttcagcgtctatgactttgaccgcttctcgcggcacgacctcatcggccaggtggtgctggacaacctcctggagctggccgagcagccccctgaccgcccgctctggagggacatcgtggagggcggctcggaaaaagcagatcttggggagctcaacttctcactctgctacctccccacggccgggcgcctcaccgtgaccatcatcaaagcctctaacctcaaagcgatggacctcactggcttctcagacccctacgtgaaggcctccctgatcagcgaggggcggcgtctgaagaagcggaaaacctccatcaagaagaacacgctgaaccccacctataatgaggcgctggtgttcgacgtggcccccgagagcgtggagaacgtggggctcagcatcgccgtggtggactacgactgcatcgggcacaacgaggtgatcggcgtgtgccgtgtgggccccgacgctgccgacccgcacggccgcgagcactgggcagagatgctggccaatccccgcaagcccgtggagcactggcatcagctagtggaggaaaagactgtgaccagcttcacaaaaggcagcaaaggactatcagagaaagagaactccgagtgaggggtctggcctaggcccgggatcggaccaggctccctcaggaccccatcctttcctgcccggaccgtgaattcatctccttgaagccataacgtccgagctgctggtgcggggcagccctggccctaggcttcctaaccctggaagcgagaggatgagaggaggccggcccagctccttctttcagggtgggggtcattcagcctccactgtgtctgtcttttcttccctggggctccccctcgaggcgaggggccatgcatgtctgggggacccctgccccccaaaaccctctgtctgtctctgtctctttgctgtttgtccaagactcagtgtcccgacccttgttctcgccgtgaatgtcaatgggccaatcctctctgtcctttcagacacacacacacctgtgtccaccccttctgttcgccacaccctgcgtctggccggtccccccactgctgctgctatcaacgccagaataaacacactctgtgggtctcactccaaaaaaaa

SEQ ID NO: 75 - DNA, 1280 bp, Homo sapiens
ccctttcgctgcggcctttccccaacccggacccggcacttctcgggttccgcgactgccgatcgccccggcgcggcaccgctccctcaggagtcgcctaggccgcgcagtctcccgacttctcgtcaggctttcgcgccggcgctccagcaatcactggctggagaaggtgggcgttccggctcgagaggaccctgccgcggctccggaagagcctcgtcctgggcggcggtggtgcggcggtcgccgttatggccactgggctgggcggctgaccgcgggctaggaaagggcccagggcccgaatctcggtggccgctgctccagcgcggcctgcgccatggcctcctccgccgcctcctcggagcatttcgagaagctgcacgagatcttccgcggcctccatgaagacctacaaggggtgcccgagcggctgctggggacggcggggaccgaagaaaagaagaaattgatcagggattttgatgaaaagcaacaggaagcaaatgaaacgctggcagagatggaggaggagctacgttatgcacccctgtctttccgaaaccccatgatgtctaagcttcgaaactaccggaaggaccttgctaaactccatcgggaggtgagaagcacacctttgacagccacacctggaggccgaggagacatgaaatatggcatatatgctgtagagaatgagcatatgaatcggctacagtctcaaagggcaatgcttctgcagggcactgaaagcctgaaccgggccacccaaagtattgaacgttctcatcggattgccacagagactgaccagattggctcagaaatcatagaagagctgggggaacaacgagaccagttagaacgtaccaagagtagactggtaaacacaagtgaaaacttgagcaaaagtcggaagattctccgttcaatgtccagaaaagtgacaaccaacaagctgctgctttccattatcatcttactggagctcgccatcctgggaggcctggtttactacaaattctttcgcagccattgaacttctatagggaagggtttgtggaccagaactttgaccttgtgaatgcatgatgttagggatgtggatagaataagcatattgctgctgtgggctgacagttcaaggatgcactgtatagccaggctgtgggaggagggaggaaagatgaaaaaccacttaaatgtgaaggaacaacagcaacaagaccagtatgatataccaaggtaataaatgctgtttatgacttctttaaaaaaaa

SEQ ID NO: 76 - DNA, 970 bp, Homo sapiens
ctgattatagttctgaggccctagctactcactttgcaaactccaggctccggtcgcgcacgggacgaactgcggggagtgagccgcgcgggccgccgtagtcagctgctaagagcaggaagagtccgagcggcgggcggagtctgcaggatggcaccggacccctggttctccacatacgattctacttgtcaaattgcccaagaaattgctgagaaaattcaacaacgaaatcaatatgaacgaaaaggtgaaaaggcaccaaagcttaccgtgacaatcagagctttgttgcagaacctgaaggaaaagatcgcccttttgaaggacttattgctaagagctgtgtcaacacatcagataacacagcttgaaggggaccgaagacagaacctcttggatgatcttgtaactcgagagagactacttctggcatcctttaagaatgagggtgccgaaccagatctaatcaggtccagcctgatgagtgaagaggctaagcgaggagcacccaacccttggctctttgaggagccagaggagaccagaggcttgggttttgatgaaatccggcaacagcagcagaaaattatccaagaacaggatgcaggccttgatgccctttcctctatcataagtcgccaaaaacaaatggggcaggaaattgggaatgaattggatgaacaaaatgagataattgacgaccttgccaacctagtggagaacacagatgaaaaacttcgcaatgaaaccaggcgggtaaacatggtggacagaaagtcagcctcttgtgggatgatcatggtgattttactgctgcttgtggctatcgtggttgttgcagtctggccgaccaactgatggcagtaaagagaccaccagcagtgacacctggcaatgacagatgcaagcccaacacccttttggtacgcaaaacctgctctcaataaattcccccaaagctctgaaa

SEQ ID NO: 77 - DNA, 1709 bp, Homo sapiens
gacccggagcagcagcagaggcaggaggactaggaggaggaggaggagccgtcgcaggatgaaggatcggactcaagagctgcggagtgcgaaagacagtgatgatgaagaggaggtggtccacgtggatcgggaccacttcatggatgagttctttgaacaggtggaagagatccggggctgcattgagaaactgtcggaggatgtggagcaggtgaaaaaacagcatagcgccatcctggccgcacccaacccagatgagaagaccaaacaggagctggaggatctcactgcagacatcaagaagacggccaacaaggttcggtccaaattgaaagcgatcgagcaaagcattgaacaggaggaggggctgaaccgttcctccgcggacctgcgcatccgcaagacccagcactccacactgtcccggaagttcgtggaggtaatgaccgaatataacgcgacccagtccaagtaccgggaccgctgcaaggaccggatccagcggcaactggagatcactggaaggaccaccaccaacgaagaactggaagacatgctggagagcgggaagctggccatcttcacagatgacatcaaaatggactcacagatgacgaagcaggcgctgaatgagattgagacgaggcacaatgagatcatcaagctggagaccagcatccgcgagctgcacgatatgtttgtggacatggccatgctcgtagagagccagggagagatgattgaccgcatcgagtacaacgtggaacattctgtggactacgtggagcgagctgtgtctgacaccaagaaagcagtgaaatatcagagcaaggcccggaggaagaaaatcatgatcatcatttgctgtgtggtgctgggggtggtcttggcgtcatccattggggggacgctgggcttgtaggccccccccacccttctctctcccagacccttcccccaccacatcgggagcaatacccccaccacccctttcactccatcccctgctccaggctcactcccaaaacagacccaggcagccccacccctcctccacccccacggcagaccctggtgtccctggacctcaccgggccatggacccccccccgtccccgcacgtagatcgcagcaggcgtgattacacatgcacaccaacatgcatgccgccggcacatgctcgagacgtgtggacaccccagcgtgcgtgtgcgtgtgatgtgtgtgatgcaccagagcaccccctccacccccaccttgggtgtgtgtgcgtggtctgagcttcccccttcaccggggctgttgtgtagactgcagccaagtgtaacacagcagtccatcacgccctctctgtcctctgtgaacagtgtgtgtgcgtgcgtgagaccacagatctgtggacacaccatttgtgtacgtggaattttgtgtttcagtgtttgaacctaatgcaacagcaacaaagccactgatacctgagccctttgtgtctgctacaaaccaggcaggtggtgtgtgtggactcacactcacattctcagaggatccagggaggcccaggtacacacaggccatggcagacaccccatgtctttgttaccccaggggctgtggcatgtcccaggagggtgtgcatgtgtgtgtgtgtgtgtgtgtgtgtgtccaggatgtgcctgaagtattgataggtcttctcagatagagcc

SEQ ID NO: 78 - DNA, 850 bp, Homo sapiens
gggcgataatggcggcgtcgaggctggagctaaacctggtgcggctgctatcccgctgcgaggcgatggcagcggagaaacgggacccggacgagtggcgcctggagaagtacgtgggagccctagaggacatgttgcaggccctgaaggtccacgcgagcaaaccggcctctgaggtgatcaatgaatattcctggaaggtggattttctgaaggggatgctgcaagccgagaagctgacctcctcctcagagaaagcactggccaaccagttcctggcccctggccgtgtgccaaccacagccagagagcgagtgcccgccacaaagacggtgcatctgcagtcacgggcgcggtacaccagcgagatgcggagtgagctactaggcacggactctgcagagcctgagatggacgtaaggaagagaactggagtggcagggtcccagccagtgagtgagaagcagtcggcagctgagctagacctcgtcctgcagcgacatcagaacctccaggaaaagctggcggaagagatgctaggactggcccggagcctcaagaccaataccctggccgcccagagtgtcatcaagaaggacaaccagaccctgtcacactcactgaaaatggcggaccagaacctggagaaactgaagacggagtcagagcgtctggagcagcacacgcagaagtcagtcaactggctgctctgggccatgctcattatcgtctgcttcatcttcattagcatgatcctcttcattcgaatcatgcctaaactcaaataaagacccccgcccacctaaaaaaaaaaaaaaaaaaaaaaaaaaaaaaaaaaaaaaaagaaaaa

SEQ ID NO: 79 - DNA, 1410 bp, Homo sapiens
gatcggactcaagagctgcggagtgcgaaagacagtgatgatgaagaggaggtggtccacgtggatcgggaccacttcatggatgagttctttgaacaggtggaagagatccggggctgcattgagaaactgtcggaggatgtggagcaggtgaaaaaacagcatagcgccatcctggccgcacccaacccagatgagaagaccaaacaggagctggaggatctcactgcagacatcaagaagacggccaacaaggttcggtccaaattgaaagcgatcgagcaaagcattgaacaggaggaggggctgaaccgttcctccgcggacctgcgcatccgcaagacccagcactccacactgtcccggaagttcgtggaggtaatgaccgaatataacgcgacccagtccaagtaccgggaccgctgcaaggaccggatccagcggcaactggagatcactggaaggaccaccaccaacgaagaactggaagacatgctggagagcgggaagctggccatcttcacagatgacatcaaaatggactcacagatgacgaagcaggcgctgaatgagattgagacgaggcacaatgagatcatcaagctggagaccagcatccgcgagctgcacgatatgtttgtggacatggccatgctcgtagagagccagggagagatgattgaccgcatcgagtacaacgtggaacattctgtggactacgtggagcgagctgtgtctgacaccaagaaagcagtgaaatatcagagcaaggcccggaggaagaaaatcatgatcatcatttgctgtgtggtgctgggggtggtcttggcgtcgtccattggggggacgctgggcttgtaggccccccccacccttctctctcccagacccttcccccaccacatcgggagcaatacccccaccacccctttcactccatcccctgctccaggctcactcccaaaacagacccaggcagccccacccctcctccacccccacggcagaccctggtgtccctggacctcaccgggccatggacccccccccgtccccgcacgtagatcgcagcaggcgtgattacacatgcacaccaacatgcatgccgccggcacatgctcgagacgtgtggacaccccagcgtgcgtgtgcgtgtgatgtgtgtgatgcaccagagcaccccctccacccccaccttgggtgtgtgtgcgtggtctgagcttcccccttcaccggggctgttgtgtagactgcagccaagtgtaacacagcagtccatcacgccctctctgtcctctgtgaacagtgtgtgtgcgtgcgtgagaccacagatctgtggacacaccatttgtgtacgtggaattttgtgtttcagtgtttgaacctaatgcaacagcaacaaagccactg

SEQ ID NO: 80 - DNA, 1730 bp, Homo sapiens
ccgttctgctctcgggggcaccttccggggttcctaagccgcggggcccctcgctgcccctcgaggccctttccctgacctaggctttggcctgggctactcgttccggagccgccatgtcgtccgacttcgaaggttacgagcaggacttcgcggtgctcactgcagagatcaccagcaagattgcgagggtcccacgactcccgcctgatgaaaagaaacagatggttgcaaatgtggagaaacagcttgaagaagcgaaagaactgcttgaacagatggatttggaagtccgagagataccaccccaaagtcgagggatgtacagcaacagaatgagaagctacaaacaagaaatgggaaaactcgaaacagattttaaaaggtcacggatcgcctacagtgacgaagtacggaatgagctcctgggggatgatgggaattcctcagagaaccagagggcacatctgctcgataacacagagaggctggaaaggtcatctcggagactagaggctggataccaaatagcagtggaaaccgagcaaattggtcaggagatgttggaaaaccttagtcatgacagagaaaagatacagcgagcacgtgaaagacttcgggaaacagatgctaatttgggaaaaagctccaggattctgacagggatgttgcgaaggggttgttctgtgaaaaaacaatgtaacctgtctctggccccaaaggcttgaaccagaaccagccagtggaaattactcaaacacgtattgtgccttcaatgagaagccttctcactgaaagagctgccctggacggaaaatgagtagtgagatgatgctggtggaagtatttatagatgcgcagtgcatgagtacttggcaaggatgctatcaaaggggaaactgacatcaaatgtgctgtggttctgggtgatttatctggtcccttcccatcccagagctttatgattctgtaataatcaagggagaaacccattacatagtggacaattttttttctttttttttctttttctttttttttttgagacagagtcttgccctgtcgcctggctggagtggagtggcacaatcttggctcactgcaacctccacctcccaggtccaagcgattctcttgcctcagcctcccaagtagctgggactacaggcacacaccaccacgcccagctaatttttgtatttcttttttttttttttgtagagatggagtttcaccatgttggccaggatggtctcgatctcttaaccttgtgagccaccgtgcccaaccctaacaattatttttaaaaggaggaatttaaatgagctgtggattattcattttgtcccataagaagataattaaaaaatgacaaaaatgaactgaacaaaaaagttctaacaaaataataaggctgaatttttaaagtctcttccgcatcttctgttccctgggatgccttagacggggtgtgcagtattttaggtacatcgtgagcaaggagcctgcattcccagggggcggcagggacagcatgtaaggtcttagtccagctctgtgatctgaaggcaaagcctctatgtgtgaaacacaggggtacctcaaaaatagaacaagagcactccatccatgtgcggatgactgtcaaggtcactgagacctacagtgatctggaaaattaaagctctctggccgcctttcctctcaggacatacttctggagatcaaaa

SEQ ID NO: 81 - DNA, 1830 bp, Homo sapiens
gcccaccgaccggcctcgagcgccccggcgggaggtttttctatatgagtggagaagacagctgttaccagggaggtcatacaacatttttttaggatgtctgaagatgaagaaaaagtgaaattacgccgtcttgaaccagctatccagaaattcattaagatagtaatcccaacagacctggaaaggttaagaaagcaccagataaatattgagaagtatcaaaggtgcggaatctgggacaagttgcatgaagagcatatcaatgcaggacgtacagttcagcaactccgatccaatatccgagaaattgagaaactttgtttgaaagtccgaaaggatgacctagtacttctgaagagaatgatagatcctgttaaagaagaagcatcagcagcaacagcagaatttctccaactccatttggaatctgtagaagaacttaagaagcaatttaatgatgaagaaactttgctacagcctcctttgaccagatccatgactgttggtggagcatttcatactactgaagctgaagctagttctcagagtttgactcagatatatgccttacctgaaattcctcaagatcaaaatgctgcagaatcgtgggaaaccttagaagcggacttaattgaacttagccaactggtcactgacttctctctcctagtgaattctcagcaggagaagattgacagcattgcagaccatgtcaacagtgctgctgtgaatgttgaagagggaaccaaaaacttagggaaggctgcaaaatacaagctggcagctctgcctgtggcaggtgcactcatcgggggaatggtagggggtcctattggcctccttgcaggcttcaaagtggcaggaattgcagctgcacttggtggtggggtgttgggcttcacaggtggaaaattgatacaaagaaagaaacagaaaatgatggagaagctcacttccagctgtccagatcttcccagccaaactgacaagaaatgcagttaaaaaccaaatttcagtattattggtgccaacatgtctatcctgaggacctttgctgctgttggacactccgtcaccttttggaacacaagtatatcaagatagtggctactgatgttcaagtgggattgaagtgtgataaatggatatattttgttgtttgctggggtgttcatggagatgttaagagattgaggccctgggctgagggtatataatgtatgtcaggtaaagtttgaagactgccaaggagcagattttctccctggaaatgtgaaaactgaacctataactctgataaggacttgagatgtgtagaaacgttgggttatggaagactagtttcttccataaccctgaattggagaccttaatgctaagtgtagattattgaggtttgttagtgaggaaaagaataagagttcagaagcctttgttatcagatagcgaaatcagggcctagtgaggagcacaggtcgactacataatggagtccattggcgaaccctattgcaatttggtccaactatatcttctggtgaaggaaattaatgatgtaagaaaatgcaagaggctcaacttctcttccaaaaatcttctggcttctgaactcttcctctgcctctctttaaataaataacacagaatttcaagtggtaggagacttattaagccagtcaccaagcttggtctgtcagcctgtcttctaacacctcaaagatcttgtgccctgtgctgtccctcccttgtaattatgaaaagttctttggtttctggggtgaattctacccatgtataatgaggaattctctcataaccttaaaaaaa

SEQ ID NO: 82 - DNA, 3330 bp, Homo sapiens
gcggagcgcgcggggcgcggttgccgtggcagcgccggctccagggagggctgctggcgccgggccgggaccgcggggcctgaggcggagaccggagagcccgcggcccggccggaggcagctcgggacaggcttgagcggcggggcgcgctgcccggccggcggggatgcgggaccggctgccagacctgacggcgtgtaggaagaatgatgatggagacacagttgttgtggttgagaaagatcatttcatggatgatttcttccatcaggtggaggagattagaaacagtattgataaaataactcaatatgttgaagaagtaaagaaaaaccacagcatcattctttctgcaccaaacccggaaggaaaaataaaagaagagcttgaagatctgaacaaagaaatcaagaaaactgcgaataaaattcgagccaagttaaaggctattgaacaaagttttgatcaggatgagagtgggaaccggacttcagtggatcttcggatacgaagaacccagcattcggtgctgtctcggaagtttgtggaagccatggcggagtacaatgaggcacagactctgtttcgggagcggagcaaaggccgcatccagcgccagctggagataactgggagaaccaccacagacgacgagctagaagagatgctggagagcgggaagccatccatcttcacttccgacattatatcagattcacaaattactagacaagctctcaatgaaatcgagtcacgtcacaaggacatcatgaagctggagaccagcatccgagagttgcatgagatgttcatggacatggctatgtttgtggagactcagggtgaaatgatcaacaacatagaaagaaatgttatgaatgccacagactatgtagaacacgctaaagaagaaacaaaaaaagctatcaaatatcagagcaaggcaagaaggaaattgatgttcattattatttgtgtaattgttttgcttgtgatccttggaattatcctagcaacaacattgtcatagcaaccatatcccaagagccatttatccttgagactcagaccacatctgcaaccaaatcagcatcctgtcatttcgtgaatgaatctcagacgctgtaacccggcatcgagtgctgaccttgtaatgtatgagttcacggaagaagcacaaccgaacgtcttgttcagtgacagcgccgtaagcacagtgggtgtgatgcgtgaccctgaatgacacactacagaatgtgagcagtgtgagacttctctcactggccttgaaataagaaaatattgaacattttaatattaaaaatatttcagtgttaacaaatgtgcatgaagtttaattaggaaggaatgctttatgttatgaaggctttttttttttttttttgagacggagtctcgctttgtcatccaggctggagtgcagtggtgcgatctcagctcactgcaacctcagcctcccgggttcaagcaattctcctgcctcagcctcccgagtagctgggattacaggcatgggccaccacacccagctaattttttgtgttttctttttagtagagacggggttttaccatgctggccaggctggcctcaaactcctgaccttgtgatccacccacctcagcctcccaaagtgctgggattacaggcgtgagtcaccgggcaggctgttctgaagcttttagatctcaggtctaaggcttcctttccctccctctcccagctagtttgtgctaattaagagaccttttatactgttttattgcctgtttgaagaaataatttttatcacgtttttgtaagatatctataattttaaatgtttataaattgtttaatttattagcatcttaatgtaccccatttttatatactgaatgtggccttttgagtgaaataggaagcttcatggtgttggagccacctttgtacagttgtttaaagtttcccattgtcacggaaaacattggctgcaaagcccctcaaagccctcaagtgccttctgtgagtttaaatgtgctggtgccctccagaaaagcctcggcctcagctccgtttccgcctgttccctcccccaggataatgaatggttactgcactgtaaagaccgtggtctcttttcactaaataggagattcgagtttcccagtttacatgaatgaagtctgaatttaagacggtgatgaaactgaggttcagtactctcgggactcgaggaaattattcctgagacatggagtaattcttacaaatttaaactattgtacagatccacatacatgttgttaagtacctaatgttttgctgaacttttaaaagttaatttccaaaatgtatagggattcatgataattaaacctttttattgctcatttttttagtagaagaatatcacttatttttagacttgtaaaatgtatgaactggtgagcggacatctgttaagagagtcactagtcagaatgttaaaggagtgcatgcaggatgccccaaatgtcgtgaactcttgttactcctgtatgtagtagtgtaagcatgtgacttttaacaccatttggtttgaaactaatgtagagatgcctgattccaaacaggtgtggagaatattgaacggctcagaagccgcgtcccttacttaacacaattccgaatctccctcatccatgatgcgtccattggatcactcgctggtggtcactgtgtggcagttactaggggaattctgcctctgactgttctttttcttttggtctttaaacaccctgtcgtgggatgtgctcactgatttgtggctatgttgaaggtatcacttgtcttgagggttttcaatatttcaggatcatgctggtggcaaaaggactccacgcctctgtggaatcatgtccacagggggacctgcctcccgtgatgtcccacctttccttcaaggtctgtcatatgagtcctccccttttacaacacttattatggtatttttcaagttattcttcttagatttgcagtacctactgaaatttgtgtttttatagttgaagttaggaaaatgctatttgatttgtatttagatatttaagtcacttgtccaatgatgtgtatgtctaagcctcatgtaccgatttgaagtcagacttaaaaatgtatttacagattcacttgagactttttaatcggttcttcaaatatttcatgtttacattaaaaatttccagagaagcataaaagtattcactttcctgccttgtcatttctggaaagattttggggagatattttattgcatattaattaataaattgttctactaggaa

SEQ ID NO: 83 - DNA, 1390 bp, Homo sapiens; identical to SEQ ID NO: 70

SEQ ID NO: 84 - DNA, 2140 bp, Homo sapiens
gtgacgcgccctcctcgcggtgcccttcagccgccgccgcagctcaccgggcgccacatggacccagccggcccgagcgcgccccgccgctgaccgcccgcgccccgggaaggaagaacactcgctcccggccatacttgcgtgtgagttctgacccctggaggagccactgtggaagcagagcaatcgccatggagtttgtgatgaagcaggctctaggaggggccaccaaggacatggggaagatgctggggggtgacgaggagaaggacccagacgccgccaagaaggaggaggagcggcaggaggcgctgcgccaggcggaggaggagcgcaaggccaagtacgccaagatggaggcggagcgcgaggccgtgcgccagggcatccgagacaagtacggcatcaagaagaaggaggagcgcgaggccgaggcccaggccgccatggaggccaactccgaggggagcttgacgcggcccaagaaggccatcccgccgggctgcggggacgaggtggaggaggaggacgagagcatcctggacaccgtcatcaagtacctgcccgggccgctgcaggacatgctcaagaagtagccccgcgcgggacagcggccccgcggagcccccgcccctccccctacagatcctccgcggaggcccctgagggacgagcagagcgcagcccccacgccgatataagccatagccccaggcccgccctgcccgcgcccgccgcctccctcacccggcaaggggcgcgcgcccccaggacccccccagtccgccccgtgctcctctgcccgcgggtggctggagccccatcgcctgggacgcccctttctcttgctgtttaccgcccacccagcagcgcccgaggccagggccgccgaagggcagccccgcgaccacccctgtgcgcgcgttcgcggcggtgggcgcctgtcgggcccgcactcaggagcacagccatagcagacgggggggtgcgggcggggcgagggcggcggggcctgggtccccctcctgcacgcggactccggggttcggatcgctccgccgtgagtatttgcgtccgcacgcggccgctctccgccccccggcctggccccctcgcgcccctgtccatccgtctctgtccgcgtcctttcctctcctctctggaaggttttgcttcttacgaacgccacggccgtgttcacttctaaactaaagaaaacaaagcaataggtttgggggacgcccagcccccacccccgtcaccccgctcttcccgagtcctcgccccccgcccggcctcctagcctctccgcccacgcggctgctgcttctccctggggaggacccctgccctcggccattgaacactgcaccctccacaggagccgcagaggcccgaggcaccggacgctggagaccctgcgcccctgcccagcacctcctccgtgggcagctcctcgggtggggcctgcggggttccctgcgcgcagccggcgcgtgtgtggcctaatccacctggtggccctgcggggcggcatccgagcccctgtttctcctccattcatgtttaatttgcatcacaatttgttgaatctcaggtaaatgaggtctttgcatttaatgagttttatcttgacaggcgccgcctcgcccccgggccctttcgtccacatcaaaaatgcatcaagtctccacgtgtttcgggccagggcgtggcttggcattgaccttcatgaccttacatagctttagagaagccataacgttagactgcaatactaacgaccgacgcccctccgggcagagacaaccgcgcccctctgcgccccagcgacgcggcccgcggggacgtcgctgtccgtcctgctcgccctgtgccctctcactgacttctcccgggtcgtgtcttttaaaaactcctgttttcacaccttacaaagccagctctgagcagacagggcgtcctctcgtagaacctgcgcaccccgttcccagcgcatggcgccccgggccgcgagcttagcttagaccgtggtgtcctctgtccgtctgtcctgcgcctgcgcctcctcctgcatgtcggggcccctgcgtgtgttctctccggatggaatcacagccaataaacaccagtgatttca

SEQ ID NO: 85 - DNA, 2940 bp, Homo sapiens; identical to SEQ ID NO: 53

SEQ ID NO: 86 - DNA, 2880 bp, Homo sapiens
gtcgacccacgcgtccggagcggtgtagagcgagcaggtctcagctcctcgtcatgtcatacggtcccttagacatgtaccggaacccggggccctcggggccccagctccgggacttcagcagcatcatccagacgtgcagcggcaacatccagcggatcagccaagccactgctcagataaagaatttgatgagccagctaggaactaagcaggactcaagcaagctacaggaaaatctgcaacagttacaacactccacaaatcagctcgccaaggaaacaaatgaattgctgaaagaattagggtccttgccccttcccttatctacttcagaacagcgccagcagagacttcagaaggaacgcctcatgaatgacttctctgcagccttaaacaatttccaggctgtgcagagaagggtatctgaaaaggaaaaggagagtattgccagagcaagagctggatctcgtctttctgcagaagagaggcaaagagaggagcagctggtctcatttgacagccatgaggagtggaaccagatgcagagccaggaggatgaggtggccatcactgagcaggatttggaacttattaaagaaagagaaacggcaattcggcagctggaggctgacattttggatgtcaatcagatatttaaagatttggccatgatgatccatgaccagggtgatctgattgatagcatagaagccaatgtggaaagctcagaggtgcacgtcgaaagagccactgaacagttacagcgagctgcttactatcagaaaaaatctcgcaagaagatgtgtatcctggtgcttgtcctgtcagtgattattctaatcttgggacttattatctggctagtttataaaacgaagtgattgcctccgatcgttctcccgctgagctgttttcaagggcaagtgcttgttgaagtcttgccagaacaaactgatcacaagaagacagcatatatcagaacgtcctgtaatcatttagttagaaactaactactaactagtctttggaattcgtgacctatggagacagtaattatcaatttattgattctattgatttctcaaattaggaattaacttatgtggattttgcttcctcttgtattctgattgcccttcatcccaagtgtttactgaaaattccattctagatattcttgttttgacaaatgacactacagtctcgtaatattgtcttttatgtatatacaaaatttacctttttactagcatctgagatagagttactttctggtacccagtatattggagtctgtcagaaactctataataggccaccagtttttattatttaacatttttatttgaatttctaagaagcctattctctatctattttgaaagattttggcactatatttaattggaaggtaaaatattgtacatgtgatccagagtaaatgagaagtctctatctgagctggtcagttactggagtacatgttactaatctgggtttaaagtttacttcattatctgctagtgtcatccacagcagttcatcctcatccacactaagccatcctgttagcttttaaaggaagttaatttaattaacattaatatactctatgggctccctctcccacctgtctgcatagaaaggcagaattagacatagcatgctttggaaaagcaaataggaattgttgggaatgatttaatcttgttgttgttgttgttgttgttcacttgtggttctacattcctggtgaatgatgaatgttgctgtcaaagggctgccccctaccttataagggttgctgggcatttgaaggcaggaagatttttaaagatagattgaggttggtttaaaattattcctgtaaaccaacaataaagcaaagaagaggttcatttttgtaaataacactggtttcaaatagtgatgttagacttaacctaatttataaacaagagattaatatctccatgcatagttttagacaaaaaaagatgtttcaataaaattactgtcttgtaatataaatgttgtccacttcccttttccacaggcctagaacagttaaagggaacataatttgtttaggctcccacataaatgtgaatctggccaacaactttggttcatcctttagtgaattagaggatttggctaccctgagtatatttatattcatttcttctgttctccttctgttattatacttaatcttctaaactaaactaatgtgaacagtagggaagcaagggcccaaatgcataagtttctttgcactgttgcacttacttaatacaaataaatgttttttaaagcttttgtagtatgtttttatgagttaacatcctaatgtggtaggtattaggtaatgtgctgtcatgagaaaaattgagacttccaagaaaactggacaccaggtgagggttggtttggagacggaataggtgtagctgcctttccttgaaaaacagtgtgtagagatggctgagtgcaatggctcacacttgtaatcccaacactttggaaggctgaggcgggaggatcagtatatcggtacgtctgagcccaagagttcaagatcagcctgggcagtatagcaagaccccatctccattttttttttaatgattttttaattaaaaaaaagaacaacaggatagagctgttggggtggcacagtggcccaaagagcagcttcagagataattccttggttctatgatccctgtttaactccaaattacagtcggacttggatacatcatttgtaacattgtaggaaagaaaaaagtcttggttgtgaaaaacgatttgcatttgggtaaaataaagtgaccatgcttttgttctgtaaaaaaaaaaaaaaaaaaaaaa

SEQ ID NO: 87 - DNA, 2590 bp, Homo sapiens
gacaaagatggcggcagggaccagcagttactgggaagatctcaggaaacaggctcgacagctggaaaatgaacttgacctgaaactagtttccttcagcaaactatgtacaagttacagtcatagcagtacccgagatggaagacgcgacaggtatagttctgatacaacaccccttttaaatggatcaagccaagacagaatgtttgagacaatggcgattgagattgaacaacttttggcaaggcttacaggggtaaatgataaaatggcagaatataccaacagtgcaggtgtcccctccttgaatgcagccctgatgcatacattacagcggcatagagacatattgcaggattatacacatgaattccataaaaccaaagcaaactttatggcaatacgggaaagggagaatcttatgggatcagtacgaaaagatattgagtcatataaaagtgggtctggagtaaacaacagaagaactgagctatttttgaaagaacatgaccaccttcgaaactcagatcgtctgatagaagagacaataagcattgctatggcaacaaaagaaaatatgacttcacagagaggaatgttgaagtcaattcacagcaaaatgaacactttggccaatcgttttcctgctgtaaacagcctgatccagaggatcaacctgaggaagcggcgggactcgctcatcctagggggtgttattgggatctgtaccatcctgttgctgctgtatgcgttccattgatgggacatcttcagggactcttgacagccaccgctttcacaccctggtctggaataaggaaacatcggagggagaagttgactgtcttgataattagcctgaccagcaggatgaatgcaagactgacagtgatggactctgtgacatggtcaggttgagctgaagccacagtttctctgtgctgtgttttctaacacatttttctgtttttaattaaaaaaaaaaaaaaaaggttttcagttgcttttgtctccctaggaggcaggtaaaccaatcaaaaacagagttttctgtgtttccatgatagtgttgaagcctaatgacaagccaggtcttacagctgggctcttcagaaaaccaggtttctacatccaaagactgcttttcttttagctgccagattggattgtgaataaaaataattcttccctctccctctccctctccccacggtctccctctttccacggtctccctctgatgccgagccgaagctggactgtactgctgccatctcggctcactgcaacctccctgcctgattctcctgcctcagcctgccgagtgcctgcaattgcaggcgagcgccgccacgcctgactgcctcggcctcccgaggtgccgggattgcagacggagtctcgttcactcagtgctcaatggtgcccaggctggagtgcagtggcgtgatctcggctcactacaacctccacctcccagccacctgccttggcctcccaaagtgccgagattgcagcctctgcccggccgccaccccgtctggaaagtgaggagcgcctctgcccggccgccatcccatctaggaagtgaggagcgcctcttcccagccgccatcccatctaggaagtgaggagcgtctctgcccggccgcccatcgtctgagatgtggggagcgcctctgccccgccgccccgtctgggatgtgaggagctcctctgcccggccgcgaccccgtctgggaggtgaggagcgtctctgtctggccaccccgtctgagaagtgaggagacctccgcccggcagccgccctgtctgagaagtgaggagcccctccgcccggcagccaccccatctgggaagtgaggagcgtctacgcccgggcagctgccccgtccgggagggaggtgggggggtcagccccccgcccggccagccgccccgtccgggagggaggtgggggggatcagccccccgcccggccagccgccccgtccgggagggaggtggggggcgcctctgcccggccgcccctgcccggccgcccctactgggaagtgaggagcccctctgcctggccaccaccccatctgggaggtgtgcccagcagctcattgagaacgggccatgatgacaatggcggttttgtggaatagaaaaggcggaaaggtggggaaaagattgagaaattggatggttgccgtgtctgtgtagaaagaagtagacatgggagacttttcattttgttctgtactaagaaaaattcttctgccttgggatcctgttgatctatgaccttacccccaacctggtgctctctgaaacatgtgctgtgtccactcagggttaaatggattaagggtggtgcaagatgtgctttgttaaacagatgcttgaaggcagcatgctccttaagagtcatcaccactccctaatctcaagtacccagggacacaaacactgcggaaggcggcagggtcctctgcctaggaaaaccagagacctttgttcacttgttgatctgctgaccttccctccactattgtcctatgaccctgccaaatccccctctgcgagaaacacccaaaaaaaa

SEQ ID NO: 88 - DNA, 1920 bp, Homo sapiens; identical to SEQ ID NO: 71

SEQ ID NO: 89 - DNA, 1160 bp, Homo sapiens; identical to SEQ ID NO: 63

SEQ ID NO: 90 - DNA, 2300 bp, Homo sapiens
gggggccaggtccggtgttggggtgtccgagttgccgccggagaggagtggcctcgcccgcttgagttttgattcatcatggataatctgtcatcagaagaaattcaacagagagctcaccagattactgatgagtctctggaaagtacgaggagaatcctgggtttagccattgagtctcaggatgcaggaatcaagaccatcactatgctggatgaacaaaaggaacaactaaaccgcatagaagaaggcttggaccaaataaataaggacatgagagagacagagaagactttaacagaactcaacaaatgctgtggcctttgtgtctgcccatgtaatagaacaaagaactttgagtctggcaaggcttataagacaacatggggagatggtggagaaaactcaccttgcaatgtagtatctaaacagccaggcccggtgacaaatggtcagcttcagcaaccaacaacgggagcagccagtggtggatacattaaacgcataactaatgatgccagagaagatgaaatggaagagaacctgactcaagtgggcagtatcctgggaaatctaaaagacatggccctgaacataggcaatgagattgatgctcaaaatccacaaataaaacgaatcacagacaaggctgacaccaacagagatcgtattgatattgccaatgccagagcaaagaaactcattgacagctaaagctactgctgttcttctttatcatttattcacttccgtagctcctccttgaaagttattaccttttcagagtttaagttttcggttccacgctcttctaattgggagataatatggaagaagggccagaagcagttacagccctccttcttttttgttttctgttgagggccgactgctgctctgccttccttctagtattttctttctcaattcatacgcttagattggttttcatatgtcatgtttagtgttttcatcctcctcatatacttcagcaggttcttttgctttcaagatttggaagcattgccaaagacagccatgaagaaggaagctgtagaggtgttttttgttgttgtttatttttgcttttgtggttgagggaaggacaagagataagaggttgttacctcagtaaaaaccttcaggccacaaagcaaaaagttgcatagccacaacgaagatctagttggatatagtttttgatttaagttgcagttatagccaatttaggctaatgcttggttttggagcttttatacacaacgtttttgttaggcatcacagttttgcaacctctgctccaaagagaaaaatagaatgagttttctttcttttttttttttttggagtcagagtctcgctctcttgtccaggctggagtgcaatagcgcgatctgggctcactgcaacctccgcctccctggttcaagcaattctcctgccttgcctcctgagtagctgggattacaggcgtgtgtcaccacgctcggctaatttttgtatttttagtagagacagggtttcaccatgtcaagctggtcttggactcctgacgtcgtgatccacccgccttggcctcccaaagtactgggattacaggcgtgagccactgtgcctggctgagttttcttaaagtgagcttaatttctgaactcttagtgattcatatatgtacataaatctgtgatcccatttcttattgcaccattcaggaacactttatataaatgagtggctttttatttcatattattagtagtatcatggttccattacaggcctattaacatcatacattgtcattagtctttgaagaaaaaatatgtaaatatatatgtgtaacatgagaatttctctctaaagcagggcttaaaattttttggaaaagtttgacaaagcataccacatgaattcagatttacctcaatgctaagaattatgtttagttaggaaaaaggaaagtcattttgacctcaggtagaaaaatagattgctttgagttttatgtagctttagactttaaaaagttagaatttattctgtaactaaaaattatttgaaaaaattatgcctctggtttaattattggtgattacacactctttctcttacccttgtgtattgaactatgtccataatcaagttgatgtggatcctgaaaagtgttatgaacatctgattggtatttgtcacatttattttaaaattagcatctgaacacttcaaagctgtcagtgtgtattggtttcaccaataaccactgcttgatccttacaattaaattttttaactagcaaaaa

SEQ ID NO: 91 - DNA, 930 bp, Homo sapiens
gcgaggccctggacggcggcggcagtggggctcctccttctgtttcccagactgagagccgcgccggcaccatgtcagcttaccctaagagctacaatccgttcgacgacgacggggaggacgaaggcgcccggccggccccttggagggacgcccgagacctccccgacgggcccgacgcgcccgcggacaggcagcagtacttgcggcaggaggtcctccgcagggctgaggccacggccgccagcaccagcaggtccctggccctcatgtacgagtccgagaaggttggggtcgcctcttccgaggagctcgcccgtcagcgaggagtcctggagcgcacagagaagatggtggacaagatggaccaagatttgaagatcagccagaaacacatcaatagcattaagagcgtgtttggggggctggtcaattacttcaaatccaaaccagtagagaccccacctgaacagaatggcaccctcacctcccagcccaacaacagattgaaagaagctataagtacaagtaaagaacaggaagcaaagtaccaggccagccacccaaaccttagaaagctggatgatacagaccctgtccccagaggggctggttctgccatgagtactgatgcttacccaaagaacccacaccttcgagcctatcaccagaagatcgacagcaacctagatgagctgtccatgggactgggtcgtctgaaggacatagccctggggatgcagacagaaattgaggagcaagatgacattcttgaccggctgacaaccaaagtggacaagttagatgtcaacataaaaagcacagaaagaaaagttcgacaactctgaagacagacggatttccactctattgtgatgaaaagatttgaaagatctttttttgaacttccaagaaatttcatttactatt

SEQ ID NO: 92 - DNA, 840 bp, Homo sapiens
gagcggcgggcggagtctgcaggatggcaccggacccctggttctccacatacgattctacttgtcaaattgcccaagaaattgctgagaaaattcaacaacgaaatcaatatgaacgaaaaggtgaaaaggcaccaaagcttaccgtgacaatcagagctttgttgcagaacctgaaggaaaagatcgcccttttgaaggacttattgctaagagctgtgtcaacacatcagataacacagcttgaaggggaccgaagacagaacctcttggatgatcttgtaactcgagagagactacttctggcatcctttaagaatgagggtgccgaaccagatctaatcaggtccagcctgatgagtgaagaggctaagcgaggagcacccaacccttggctctttgaggagccagaggagaccagaggcttgggttttgatgaaatccggcaacagcagcagaaaattatccaagaacaggatgcaggccttgatgccctttcctctatcataagtcgccaaaaacaaatggggcaggaaattgggaatgaattggatgaacaaaatgagataattgacgaccttgccaacctagtggagaacacagatgaaaaacttcgcaatgaaaccaggcgggtaaacatggtggacagaaagtcagcctcttgtgggatgatcatggtgattttactgctgcttgtggctatcgtggttgttgcagtctggccgaccaactgatggcagtaaagagaccaccagcagtgacacctgccaatgacagatgcaagcccaacacccttttggtacgcaaaacctgctctcaataaattcccccaaagctctg

SEQ ID NO: 93 - DNA, 1090 bp, Homo sapiens
ccggggtaggtgggtgacggcggtcggaggtgtaggagggagccgtggaggtccaggtgactgcttagaaaactgcacagcatctgatgaaattagcgaataagaacatcaaccatgtcttacactccaggagttggtggtgaccccgcccagttggcccagaggatctcttctaacatccagaagatcacacagtgttctgtggaaatacaaagaactctgaatcaacttggaacacctcaagattcacctgaattgaggcaacagttgcaacagaagcagcagtatactaaccagcttgccaaagaaacagataagtacattaaagagtttggatctctgcccaccacccccagtgaacagcgtcaaaggaaaatacagaaggatcgcttagtggcagagttcacaacatcactgacaaacttccagaaggtccagaggcaggctgctgagcgagagaaagagtttgttgctcgagtaagagccagttccagagtgtctggcagttttcctgaggacagctcaaaagaaaggaatcttgtatcctgggaaagccaaactcaacctcaagtgcaggtgcaggatgaagaaattacagaggatgacctccgtcttattcatgagagagaatcttctatcaggcaacttgaagctgatattatggatattaatgaaatatttaaagatttgggaatgatgattcatgaacaaggagatgtaatagatagcatagaagccaatgtggaaaatgcagaggtgcacgttcagcaagcaaatcagcagctgtcaagggcagcagattatcagcgcaaatccagaaaaaccctgtgcatcatcattcttatccttgtcattggagttgcgattatcagtctcatcatatggggattgaaccactgaagttataaaggagcacactgtcgcactacattgtctaaattatgtaggaagattcctgtaatcatgtttttttaattattattttaaagctattgtataaaggatggttcccatactttgttatttttattgggggggttggggtggttcctttggattaaatctgatattttctaatactgaaaaaaaa

SEQ ID NO: 94 - DNA, 1980 bp, Homo sapiens
tgctcggcggctccaccacagttgcaacctgcagaggcccggagaacacaaccctcccgagaagcccaggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactcgatcgtgtcgaagaaggcatgaaccatatcaaccaagacatgaaggaggctgagaaaaatttaaaagatttagggaaatgctgtggccttttcatatgtccttgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcctgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccaaaaaaa

SEQ ID NO: 95 - DNA, 1739 bp, Homo sapiens
ctcagtgtggaggctgctggccctgccatctgtaagaagatgtcatacggatccatcgcccgtggaggtggcctggggagccgtggccctttcgggggaccttcgagacaaggctgtcagcccctagagtgcgctagatgttggaccgagtatggaatccgccatttcccctgcccgtcgccagagagcaagctgcagaaccgctgtgtggggaaggacggggaaggtgatctggggccagcaggcacgcctattgtcccaagggccaggaagcgagggcctggggttgcccctgaaggcagccggatgccggagcccacctcatcacccaccattggcccgaggaaggactcggctgctgggccccatggccggatggcggggcccagcactacccgggccaagaagaggaagcccaacttctgcccgcaggagaccgaggtgctggtgtccaaggtgagcaagcaccaccagctgctgtttggcacggggctgctgaaggccgagcccactcgcaggtaccgcgtgtggagccgcatcctgcaggccgtgaatgcgctgggctactgtcgccgcgacgttgtggacctgaagcacaagtggcgggacctacgagccgtcgtgcggcgcaagctgggcgacctccggaaggcggcccatggccccagccctggttccggcaagccccaggccctggctctcacgcccgtggagcaggtggtggccaagaccttctcttgccaggccctgccctccgagggcttcagtctggagccgcccagagccacccaggtcgatccgtgcaacctccaggagctgttccaggagatgtcggccaacgtcttccgaatcaactccagtgtgacctccttggagcggagccttcagtccttagggacaccgagtgacacgcaggagcttcgggacagcctgcacacggcacagcaggagaccaacaagaccattgcagccagcgccagctccgtgaagcagatggccgagctgctgcgcagctcctgcccgcaggagcgtctgcagcaggagcgtcctcagctggaccggctgaaaacccagctctcagatgccattcagtgctatggagtggtgcagaagaaaattgcagaaaagtccagagcgctgcttcccatggcgcagaggggcagtaaacagagtccccaggccccgtttgccgagctggctgatgatgagaaggtctttaacgggagtgacaacatgtggcagggccaggagcaggcgctgctcccggacatcactgaagaggacctggaggccatccggctgcgggaggaggccatcctgcagatggagagcaacttgctggatgtgaatcagatcatcaaggacttggcctccatggtgtcagagcaaggagaagctgttgatagtattgaagccagccttgaggctgcgtcctcgcatgcggaggcagcccgccagctcctggctggagccagccggcaccaactccagagacacaagatcaagtgctgcttcctatcagctggagtcactgccctgcttgtcatcatcatcatcatcgccacctctgtccgaaagtgatgctacccgtgcatcggccgctgaaccgtcagctggctgtggtgtgggctctccagccccgagcacccctcctggcccggagctgggagctgatggagtccgctgcgttgtcagctgatgccgtcacctggcctgcaatggacccgagagcttcacag

SEQ ID NO: 96 - DNA, 2090 bp, Homo sapiens
gccggcgccgctgccactcccgggagcatgaaggaccgaacccaggagctccgcacggccaaggacagcgatgatgatgatgatgtcgctgtcaccgtggaccgagaccgcttcatggatgagttctttgagcaggtggaggagattcgaggcttcattgacaagatcgcagagaacgtggaggaggtgaagcggaagcacagtgccatcctggcatcccccaaccccgatgagaagacgaaggaggagctggaagaactcatgtccgacataaagaagacagcaaacaaagttcgttccaagttaaagagcatcgagcagtccatcgagcaagaggaaggcctgaaccgctcctccgctgacctgaggatccggaagacacagcactccacgctgtccagaaagtttgtggaggtcatgtcggagtacaacgccacgcagtccgactaccgcgagcgctgcaaaggccgcatccagaggcagctggagatcaccggcaggaccacgaccagtgaggagctggaggacatgctggagagtgggaaccccgccatctttgcctctgggatcatcatggactccagcatctcgaagcaggctctgagcgagattgagacgcggcacagtgagatcatcaagctggagaacagcatccgtgagctacacgacatgttcatggacatggccatgctcgtggagagccagggagagatgattgacaggatcgagtacaatgtggaacacgcggtagactatgtggagagggccgtgtctgacaccaagaaggccgtcaagtaccagagcaaggcgcgccggaagaaaatcatgatcatcatctgctgtgtgatcctgggcatcgtcatcgcctccactgttgggggcatcttcgcctagaagccacccaaactgccactccactccaggtgggccactccaaggaggccctggctgctgccacctggctgggctgccctcccaacccccgcctctggctcagagcaccctccctcccggcccccatgctcccttctctgccatgggccctccgtccccgccccgtgtcgtgtgcatgatctctgtgagtgtgcgtctgtacgggaagaggcagagggaggcagccagcggggcgtgatgcagtgtgcacagcgaggagcagacccaggcagggccgccagggtgacacaggccacccttccttgccttcagtaactcggtgggcccaggttctgctcttccctggggaccctaacctcccctccagctgacctgccctgtcctctccagctgtccccacaagcagagccctgaggggtggggaccagctggccacatggtgctgcttttcaggttaggggagaggtggccctgagggacagcccagctctgagtctcagtcgctgatcactgccagggaggctcaggctgccatggctccaggctccctcccctgcctaggggcaaagtccatcgggtcctgggcctcagcttcccttcccacattcctccggccccaggagcaaccccttgggctaggtctgaccccaggtgtccctctggaaggggctggctggtgccctatttccagccaccccagcagctagggaggcaaagcaggctgcagtcagtccctcaagccagcgttgcatgtttgggatggtggctcctgttgtcttgcgctctgggaagtcagatgtcatttcaggcctgcagtctcatcctgcccttgccatcctcccatcgatgtgccacgtgggtgtcacgtgtcccagatgcagtattcggcagccagccggggagggctacctcctcctcctcaccaccttggggcttctcatgggaaatgtgcccccgccccaggaccctctcccttgtggacaggcagggagatgcatgcgagtgcatgcagcaggggatggggccgtgtccgtgtgccccaccctccctcggctttactcctgcccagtgactgtgaccactgtccgtgttgccttcttgaacagcgattccccccaaccccttcaccaaaggtcttggtacaaccagctgcccattttgtgaaatttttatgtagaataaacatttgtatctgt

SEQ ID NO: 97 - DNA, 1780 bp, Homo sapiens
gtgacgtggccgcttccagtctttggtcgggtttcggcggcttcagtgctcggggaggaggcagtgacggccggtgagattggaagtggcggcggcggcaggcggcagaggggagtccgaggttatgcgtctcaatgatcccgcggaaacgctacgggtctaagaacacggatcagggtgtctacctgggtctctcaaagacacaggtcctgtcccctgcaactgctggcagtagcagcagcgacatcgcccctctgccccccccagtgaccctcgtccctccccctcccgacaccatgtcctgccgggatcggacccaggagtttctgtctgcctgcaagtcgctgcagacccgtcagaatggaatccagacaaataagccagctttgcgtgctgtccgacaacgcagtgaattcaccctcatggccaagcgcattgggaaagaccttagcaacacatttgccaagctggagaagctgacaatcttggcaaagcgcaagtccctctttgatgataaagcagtggaaattgaagagctaacatatatcatcaaacaggacatcaatagcctcaacaaacaaattgctcagctccaggatttcgtgagagccaagggcagccagagtggccggcacctgcagacccactccaacaccattgtggtctccttgcagtcgaaactggcttctatgtccaatgacttcaaatcggttttagaagtgaggacagagaacctgaagcagcagaggagccggagagagcagttctcccgggcacctgtgtcagccctgccccttgcccctaaccacctgggcggtggtgctgtggttctgggggcagagtcccatgcctccaaggatgtcgccatcgacatgatggactctcggaccagccagcagctgcagctcattgacgagcaggattcctacatccagagtcgggcagacaccatgcagaacattgagtcgacaattgttgagttgggctccatctttcagcagttggcacacatggttaaggaacaggaggaaaccattcagaggatcgacgagaacgtgctaggagcccagctggacgttgaggccgcccattcagagatcctcaagtacttccagtctgtcacctccaaccggtggctcatggtcaaaatcttcctcatcctcattgtcttcttcatcatctttgtggtcttccttgcttgaaccctctctactctgaggcactctgttggggtttgggaccctcctgggaaggcaagtggccagtgctgccactgagcctgtgcagggtacttgggagaaaggccctgtttccctggaactgctaagaatgaccactgcccctgatcccccaccccttgcctctggccaccctgtcttccccccaccaccctcaggcctatgaaacacacagggttctagatttgaactctgctgtgaagtgactggaagggagcagaggccagctgggggccagtgggggaggttgtttccactaggagatttttataaaccctctccagcctctcccaaaggaagcgttggcagcaaagggagatgatgcccttacccaccttcctgtgagtgaagagaggaagcagccccagggaccaattttcccaattgacctctttcttcctctttcaccatgtgaggcagggagccctgagcccttcagctgcctgcacaacccctgacattggctgctggtgactcaatctgccaaatgtgctgcagctcgttttctcccaattacagcaagactgtcagcctcaaaaaaa

SEQ ID NO: 98 - DNA, 1019 bp, Homo sapiens
tctgtttcccagaccgagagccgcgccggcaccatgtcagcttaccctaaaagctacaatccgttcgacgacgacggggaggacgaaggcgcccggccggccccttggagggacgcccgagacctccccgacgggcccgacgcgcccgcggacaggcagcagtacttgcggcaggaggtcctccgcagggctgaggccacggccgccagcaccagcaggtccctggccctcatgtacgagtccgagaaggttggggtcgcctcttccgaggagctcgcccgtcagcgaggagtcctggagcgcacagagaagatggtggacaagatggaccaagatttgaagatcagccagaaacacatcaatagcattaagagcgtgtttggggggctggtcaattacttcaaatccaaaccagtagagaccccacctgaacagaatggcaccctcacctcccagcccaacaacagattgaaagaagctataagtacaagtaaagaacaggaagcaaagtaccaggccagccacccaaaccttagaaagctggatgatacagaccctgtccccagaggggctggttctgccatgagtactgatgcttacccaaagaacccacaccttcgagcctatcaccagaagatcgacagcaacctagatgagctgtccatgggactgggtcgtctgaaggacatagccctggggatgcagacagaaattgaggagcaagatgacattcttgaccggctgacaaccaaagtggacaagttagatgtcaacataaaaagcacagaaagaaaagttcgacaactctgaagacagacggatttccactctattgtgatgaaaagatttgaaagatctttttttgaacttccaagaaatttcatttactattttagtatgtaaattaatgtgtgtttgcaaatgttataatagagtaggtcttaagacatttttgctgttataaggaagtgtttgtcccacattttcctagggttaacacctcaccaagttcttccagc

SEQ ID NO: 99 - DNA, 1130 bp, Homo sapiens
cggaagtgtccgcacgtcgggcctccgaggcttctctttctcccctggcggtccggctctcgatggtggcgtgacgggggcgggggtggcggcgcgttctcctcggttgggagggaaccagcccgcgaacccaggccgggaggggggttcggcctgggggggaagggactgacatgtctctcgaagaccccttttttgtagtccgaggcgaggtgcagaaggcggtgaacacggcccgcgggctgtaccagcgctggtgcgagctcctgcaggaaagcgcggcggtcggacgcgaggagctggactggacgaccaatgagctgcggaatggcctgcgcagcatcgagtgggacctcgaggacctggaagagaccatcggtatagtggaagccaacccaggcaagccagctgcccagaagtcacccagcgacctgctggatgccagcgcagtctcggccacatctcgctacatcgaggagcagcaggccacacagcagctgatcatggatgaacaggatcaacagctggagatggtgtctgggagcatccaggttctgaagcacatgtccggccgcgttggagaagagctggacgagcagggcatcatgctggatgccttcgcccaagagatggaccacacccagtcccgcatggacggggtcctcaggaagttggccaaagtatcccacatgacgagtgaccgccgacagtggtgtgccatcgccgtgctagtgggggtgcttctcctcgttctcatcttactattctctctctgaccccagccctccctggcaggctggtcccttaagcctggggagccaccaagcactttggagctggcctcgccccctaggaggagagggtccctcctgggtagctggagagtagagggtcccgcctggggagctgtccccatggctctcccctagagccagtgggacccttcaggaccctgggctggaaccaccaccactggtcctgtctcaagtgcacttagggggtggtggaggcagggacacctgagacacacctgtctccatttccagttccaggaccccaaagccatttgcccctgtgccttatacacgtgccaacctggaaataaaatgtcagccttttttatatgtaaa

SEQ ID NO: 100 - DNA, 885 bp, Homo sapiens
atgaaagaccgacttcaagaactaaagcagagaacaaaggaaattgaactctctagagacagtcatgtatcaactacagaaacagaggaacaaggggtgtttctacagcaagctgttatttatgaaagagagcctgtagctgagagacacctacatgaaatccaaaaactacaggaaagtattaacaatttggcagataatgttcaaaaatttgggcagcaacagaaaagtctggtggcttcaatgagaaggtttagtctacttaagagagagtctaccattacaaaggagataaaaattcaggcagaatacatcaacagaagtttgaatgatttagttaaagaagttaaaaagtcagaggttgaaaatggtccatcttcagtggtcacaaggatacttaaatctcagcatgctgcaatgttccgccattttcagcaaatcatgtttatatacaatgacacaatagcagcaaagcaagagaagtgcaagacatttattttacgtcagcttgaagttgctggaaaagagatgtctgaagaagatgtaaatgatatgcttcatcaaggaaaatgggaagtttttaatgaaagcttacttacagaaatcaatatcactaaagcacaactttcagagattgaacagagacacaaggaacttgttaatttggagaaccaaataaaggatttaagggatcttttcattcagatatctcttttagtagaggaacaaggagagagcatcaacaatattgaaatgacagtgaatagtacaaaagagtatgttaacaatactaaagagaaatttggactagctgtaaaatacaaaaaaagaaatccttgcagagtactgtgttgttggtgctgtccatgctgtagctcaaaataa

SEQ ID NO: 101 - DNA, 1106 bp, Homo sapiens
agccggctgctgagaggccggtaggcggcggcggtcccgaggggcggcggccgcgctgctccctgagaacgggtcccgcagctgggcaggcgggcggcctgagggcgcggagccatgaagctgtacagcctcagcgtcctctacaaaggcgaggccaaggtggtgctgctcaaagccgcatacgatgtgtcttccttcagctttttccagagatccagcgttcaggaattcatgaccttcacgagtcaactgattgtggagcgctcatcgaaaggcactagagcttctgtcaaagaacaagactatctgtgccacgtctacgtccggaatgatagtcttgcaggtgtggtcattgctgacaatgaatacccatcccgggtggcctttaccttgctggagaaggtactagatgaattctccaagcaagtcgacaggatagactggccagtaggatcccctgctacaatccattacccagccctggatggtcacctcagtagataccagaacccacgagaagctgatctcatgactaaagtgcaggccgaactagatgagaccaaaatcattctgcacaacaccatggagtctctgttagagcgaggtgagaagctagatgacttggtgtccaaatccgaggtgctgggaacacagtctaaagccttctataaaactgcccggaaacaaaactcatgctgtgccatcatgtgatgcagcctgccagaggcccaatgctggaatggcaccatcattcacatcagaactgcagcccctggaaaagaagagacagccatagacgaggagccagagtgggggcagactggccatttttattttgaagttcctgcgagaaatggatggtggaagggtggcgaatgttcaaattcatatgtgtggtagtgattcttggaaagaatttgaggtccccaaaggtgtatttttgggcaaatgaaaccataaactccgactggcttctgtagatgccaaagggctctttttcagctaaccctgggaaggctctgtgggagggaggtcggagccagctgtttctcgatctttggtatatctttggatcttatttgtacattaatgatattaacactcca

SEQ ID NO: 102 - DNA, 840 bp, Homo sapiens
atgcaactgacacaggatgatgatactgatgcggttgagattgctatcgacaacacggcttttatggacgagttcttttctgagattgaggaaactcggcttaacattgacaagatctcagaacatgtagaggaggctaagaaactctacagtatcattctctctgcaccgattccagagccaaaaaccaaggatgacctagagcagctcagcactgagattaagaaaagggccaacaacgtccggaacaaactgaagagcatggagaagcatattgaagaagatgaggtcaggtcatcggcagaccttcggattcggaaatcccagcactctgtcctttctcggaagtttgtggaggtgatgaccaaatacaatgaagctcaagtggacttccgagaacgcagcaaagggcgaatccagcggcagctcgaaattactggcaaaaagacaaccgatgaggagctggaggagatgttggagagtggcaacccggccatcttcacttctgggatcattgactcacagatttccaagcaagccctcagtgagattgagggacgacacaaggacattgtgaggctggagagcagcatcaaggagcttcacgacatgtttatggacatcgccatgctggtggagaatcagggtgagatgttagataacatagagttgaatgtcatgcacacagtggaccacgtggagaaggcacgagatgaaagcaaaaaagctgtgaaataccagagtcaggcccggaagaaattgataattatcattgtgctagtagttgtgttgctgggcattttagcattgattattggactttccgttggcctgaattaa

SEQ ID NO: 103 - DNA, 894 bp, Homo sapiens
atgcgcgacaggacccacgagctgagacagggggatgacagctcggacgaagaggacaaggagcgggtcgcgctggtggtgcacccgggcacggcacggctggggagcccggacgaggagttcttccacaaggtccggacaattcggcagactattgtcaaactggggaataaagtccaggagttggagaaacagcaggtcaccatcctggccacgccccttcccgaggagagcatgaagcaggagctgcagaacctgcgcgatgagatcaaacagctggggagggagatccgcctgcagctgaaggccatagagccccagaaggaggaagctgatgagaactataactccgtcaacacaagaatgagaaaaacccagcatggggtcctgtcccagcaattcgtggagctcatcaacaagtgcaattcaatgcagtccgaataccgggagaagaacgtggagcggattcggaggcagctgaagatcaccaatgctgggatggtgtctgatgaggagttggagcagatgctggacagtgggcaaagcgaggtgtttgtgtccaatatcctgaaggacacgcaggtgactcgacaggccttaaatgagatctcggcccggcacagtgagatccagcagcttgaacgcagtattcgtgagctgcacgacatattcacttttctggctaccgaagtggagatgcagggggagatgatcaatcggattgagaagaacatcctgagctcagcggactacgtggaacgtgggcaggagcacgtcaagacggccctggagaaccagaagaaggcgaggaagaagaaagtcttgattgccatctgtgtgtccatcaccgtcgtcctcctagcagtcatcattggcgtcacagtggttggataa

SEQ ID NO: 104 - DNA, 768 bp, Homo sapiens
atgtccatggaggaccccttctttgtggtgaaaggagaggtacagaaagcagtcaacactgcccagggattgtttcagagatggacagagctcctccaggacccctccacagcaacaagggaagaaatcgactggaccaccaacgagctgagaaataacctccggagcatagagtgggatctagaggaccttgatgaaaccatcagcatagttgaagcaaatcctagaaaatttaaccttgatgcaactgaattgagtataagaaaagccttcattacaagtactcggcaagttgtcagggacatgaaagatcagatgtcaacttcatctgtgcaggcattagctgaaagaaaaaatagacaggcactgctgggagacagtggcagccagaactggagcactggaacaacagataaatatgggcgtctggaccgagagctccagagagccaattctcatttcattgaggagcagcaggcacagcagcagttgatcgtggaacagcaggatgagcagttggagctggtctctggcagcatcggggtgctgaagaacatgtcccagcgcatcggaggggagctggaggaacaggcagttatgttggaagatttctctcacgaattggagagcactcagtcccggctggacaatgtgatgaagaaacttgcaaaagtatctcatatgaccagtgatcggcgccaatggtgtgccatagccatcctctttgcagtcctgttggttgtgctcatcctcttcctagtgctgtga

SEQ ID NO: 105 - DNA, 870 bp, Homo sapiens
atgaaggaccgtctggagcagctgaaggccaagcagctgacacaggatgatgatactgatgcggttgagattgctatcgacaacacggcttttatggacgagttcttttctgagattgaggaaactcggcttaacattgacaagatctcagaacatgtagaggaggctaagaaactctacagtatcattctctctgcaccgattccagagccaaaaaccaaggatgacctagagcagctcacgactgagattaagaaaagggccaacaacgtccggaacaaactgaagagcatggagaagcatattgaagaagatgaggtcaggtcatcggcagaccttcggattcggaaatcccagcactctgtcctttctcggaagtttgtggaggtgatgaccaaatacaatgaagctcaagtggacttccgagaacgcagcaaagggcgaatccagcggcagctcgaaattactggcaaaaagacaaccgatgaggagctggaggagatgttggagagtggcaacccggccatcttcacttctgggatcattgactcacagatttccaagcaagccctcagtgagattgagggacgacacaaggacattgtgaggctggagagcagcatcaaggagcttcacgacatgtttatggacatcgccatgctggtggagaatcagggtgagatgttagataacatagagttgaatgtcatgcacacagtggaccacgtggagaaggcacgagatgaaacgaaaaaagctgtgaaataccagagtcaggcccggaagaaattgataattatcattgtgctagtagttgtgttgctgggcattttagcattgattattggactttccgttgggctgaattaa

SEQ ID NO: 106 - DNA, 893 bp, Homo sapiens
gcccgcgaacccaggccgggaggggggttcggcctgggggggaagggactgacatgtctctcgaagaccccttttttgtagtccgaggcgaggtgcagaaggcggtgaacacggcccgcgggctgtaccagcgctggtgcgagctcctgcaggaaagcgcggcggtcggacgcgaggagctggactggacgaccaatgagctgcggaatggcctgcgcagcatcgagtgggacctcgaggacctggaagagaccatcggtatagtggaagccaacccaggcaagttcaagctcccagccggggacctgcaggagagaaaggtgttcgtggagcggatgcgagaggcagtccaggaaatgaaggaccatatggtcagcccaacagccgtagcatttttggagaggaataacagagagatactcgcaggcaagccagctgcccagaagtcacccagcgacctgctggatgccagcgcagtctcggccacatctcgctacatcgaggagcagcaggccacacagcagctgatcatggatgaacaggatcaacagctggagatggtgtctgggagcatccaggttctgaagcacatgtccggccgcgttggagaagagctggacgagcagggcatcatgctggatgccttcgcccaagagatggaccacacccagtcccgcatggacggggtcctcaggaagttggccaaagtatcccacatgacgagtggtgagtcccctcaggggaggggtcagtcctggtgggggcaggttgtaggtggtaccctctccccgtgacccctgaccttctcgttcccagaccgccgacagtggtgtgccatcgccgtgctagtgggggtgcttctcctcgttctcatcttactattctctctctga

SEQ ID NO: 107 - DNA, 783 bp, Homo sapiens
atgaaggaccgaacccaggagctccgcacggccaaggacagcgatgatgatgatgatgtcgctgtcaccgtggaccgagaccgcttcatggatgagttctttgagcaggtggaggagattcgaggcttcattgacaagatcgcagagaacgtggaggaggtgaagcggaagcacagtgccatcctggcatcccccaaccccgatgagaagacgaaggaggagctggaagaactcatgtccgacataaagaagacagcaaacaaagttcgttccaagttaaagagcatcgagcagtccatcgagcaagaggaaggcctgaaccgctcctccgctgacctgaggatccggaagacacagcactccacgctgtccagaaagtttgtggaggtcatgtcggagtacaacgccacgcagtccgactaccgcgagcgctgcaaaggccgcatccagaggcagctggagatcaccggcaggaccacgaccagtgaggagctggaggacatgctggagagtgggaaccccgccatctttgcctctgggatcatcatggactccagcatctcgaagcaggctctgagcgagattgagacgcggcacagtgagatcatcaagctggagaacagcatccgtgagctacacgacatgttcatggacatggccatgctcgtggagagccagcctcagggtgctttcctgaagtcctgccccgagccccaacccaaccctgaggagggggccctttggagctcgggtgcccccggccccgcagggagagatgattga

SEQ ID NO: 108 - DNA, 711 bp, Homo sapiens
atggcaccggacccctggttctccacatacgattctacttgtcaaattgcccaagaaattgctgagaaaattcaacaacgaaatcaatatgaacgaaaaggtgaaaaggcaccaaagcttaccgtgacaatcagagctttgttgcagaacctgaaggaaaagatcgcccttttgaaggacttattgctaagagctgtgtcaacacatcagataacacagcttgaaggggaccgaagacagaacctcttggatgatcttgtaactcgagagagactacttctggcatcctttaagaatgagggtgccgaaccagatctaatcaggtccagcctgatgagtgaagaggctaagcgaggagcacccaacccttggctctttgaggagccagaggagaccagaggcttgggttttgatgaaatccggcaacagcagcagaaaattatccaagaacaggatgcaggccttgatgccctttcctctatcataagtcgccaaaaacaaatggggcaggaaattgggaatgaattggatgaacaaaatgagataattgacgaccttgccaacctagtggagaacacagatgaaaaacttcgcaatgaaaccaggcgggtaaacatggtggacagaaagtcagcctcttgtgggatgatcatggtgattttactgctgcttgtggctatcgtggttgttgcagtctggccgaccaactag

SEQ ID NO: 109 - DNA, 597 bp, Homo sapiens
atgaagctgtacagcctcagcgtcctctacaaaggcgaggccaaggtggtgctgctcaaagccgcatacgatgtgtcttccttcagctttttccagagatccagcgttcaggaattcatgaccttcacgagtcaactgattgtggagcgctcatcgaaaggcactagagcttctgtcaaagaacaagactatctgtgccacgtctacgtccggaatgatagtcttgcaggtgtggtcattgctgacaatgaatacccatcccgggtggcctttaccttgctggagaaggtactagatgaattctccaagcaagtcgacaggatagactggccagtaggatcccctgctacaatccattacccagccctggatggtcacctcagtagataccagaacccacgagaagctgatcccatgactaaagtgcaggccgaactagatgagaccaaaatcattctgcacaacaccatggagtctctgttagagcgaggtgagaagctagatgacttggtgtccaaatccgaggtgctgggaacacagtctaaagccttctataaaactgcccggaaacaaaactcatgctgtgccatcatgtag

SEQ ID NO: 110 - DNA, 411 bp, Homo sapiens
atggcgggggctggttccgccgctgtatcgggggcagggaccccggtggcggggcccacaggccgcgaccttttcgccgaagggctgctggagttcctgcgacccgctgtgcagcagctcgactctcacgtacacgccgtcagagagagccaggtagagctccgggaacaaattgacaacctagccacagaactgtgccgcataaatgaggatcagaaggtggccctggatcttgacccctatgttaagaagctacttaatgcccggcgacgcgttgtcttggttaacaacattctacagaatgctcaggaacgactgagacggctaaaccacagtgttgccaaggaaacagcccgcaggagagcaatgctggattcgggaatttacccccctggctccccaggcaaatag

SEQ ID NO: 111 - DNA, 636 bp, Homo sapiens
atggataatctgtcatcagaagaaattcaacagagagctcaccagattactgatgagtctctggaaagtacgaggagaatcctgggtttagccattgagtctcaggatgcaggaatcaagaccatcactatgctggatgaacaaaaggaacaactaaaccgcatagaagaaggcttggaccaaataaataaggacatgagagagacagagaagactttaacagaactcaacaaatgctgtggcctttgtgtctgcccatgtaatagaacaaagaactttgagtctggcaaggcttataagacaacatggggagatggtggagaaaactcaccttgcaatgtagtatctaaacagccaggcccggtgacaaatggtcagcttcagcaaccaacaacgggagcagccagtggtggatacattaaacgcataactaatgatgccagagaagatgaaatggaagagaacctgactcaagtgggcagtatcctgggaaatctaaaagacatggccctgaacataggcaatgagattgatgctcaaaatccacaaataaaacgaatcacagacaaggctgacaccaacagagatcgtattgatattgccaatgccagagcaaagaaactcattgacagctaa

SEQ ID NO: 112 - DNA, 477 bp, Homo sapiens
atggataatctgtcatcagaagaaattcaacagagagctcaccagattactgatgagtctctggaaagtacgaggagaatcctgggtttagccattgagtctcaggatgcaggaatcaagaccatcactatgctggatgaacaaaaggaacaactaaaccgcatagaagaaggcttggaccaaataaataaggacatgagagagacagagaagactttaacagaactcaacaaatgctgtggcctttgtgtctgcccatgtaatagcataactaatgatgccagagaagatgaaatggaagagaacctgactcaagtgggcagtatcctgggaaatctaaaagacatggccctgaacataggcaatgagattgatgctcaaaatccacaaataaaacgaatcacagacaaggctgacaccaacagagatcgtattgatattgccaatgccagagcaaagaaactcattgacagctaa

SEQ ID NO: 113 - DNA, 693 bp, Homo sapiens
ctctaaagcgccgcagctgccaaaatgtctacaggtccaactgctgccactggcagtaatcgaagacttcagcagacacaaaatcaagtagatgaggtggtggacataatgcgagttaacgtggacaaggttctggaaagagaccagaagctctctgagttagacgaccgtgcagacgcactgcaggcaggcgcttctcaatttgaaacgagcgcagccaagttgaagaggaaatattggtggaagaattgcaagatgtgggcaatcgggattactgttctggttatcttcatcatcatcatcatcgtgtgggttgtctcttcatgaagaaccagcggaactcaaaactgctgttcaagaaacctcttcaagacttttgacttagaacctgctatattatcaagcttacctactgttatctctaaaattttttttgtgttaatgtaaagttgaatttctaggaaacgtgcctttgttttttaatatgcactccaaattagaaggccggccccgtccacattttgcacagtgcctttacagatttacgtatgggctgatgaagaggccttcttaagttccagagtgctataatctagatgtaatgttgtcactaattaattgccattactcccctttagagcacaatggatctcgagggatcttccatacctaccagttctgcgcctgcaggtc

SEQ ID NO: 114 - DNA, 760 bp, Homo sapiens
atggccaccaggcgtttaaccgacgctttcttgttgttgcggaataattccatccaaaaccggcagctgttagccgagcaagagctggacgagcttgctgatgaccgtatggcactggtgtcaggcatcagcttagatccagaagcagcgattggtgtgacaaaacggccacctcctaagtgggtggatggagtggatgaaattcagtatgatgttggccggattaagcagaagatgaaagaattggccagccttcatgacaagcatttaaacagacccaccctggatgacagcagcgaagaggaacatgccattgagataactacccaagagatcactcagctcttccacaggtgccagcgtgccgtgcaggccctgccgagccgggcccgggcctgctccgagcaggaggggcggctgcttgggaacgtggtggcctcgctggcgcaggccctgcaggaactctccaccagcttccggcacgcacagtcaggctacctcaaacgcatgaagaatcgagaggaaagatcccagcattttttcgacacatcagtaccactaatggatgatggagacgataacactctttaccatcggaggaccagttagttctggtggagcagaacacactgatggtggaagagcgggaacgagagattcgccagattgtacagtccatttctgacctgaatgaaatattcagggacttaagggcgatgattgtagaacagggtacagtccttgacagaattgactataa

SEQ ID NO: 115 - DNA, 2492 bp, Homo sapiens
gaattccggcagttggcgaccctgcactgacccgcgtccctccgtcccgagcccgcgcgccctcagagggtgcccggacagactgaagccatggcgattctttttgctgttgttgccagggggaccactatccttgccaaacatgcttggtgtggaggaaacttcctggaggtgacagagcagattctggctaagataccttctgaaaataacaaactaacgtactcacatggcaattatttgtttcattacatctgccaagacaggattgtatatctttgtatcactgatgatgattttgaacgttcccgagcctttaattttctgaatgagataaagaagaggttccagactacttacggttcaagagcacagacagcacttccatatgccatgaatagcgagttctcaagtgtcttagctgcacagctgaagcatcactctgagaataagggcctagacaaagtgatggagactcaagcccaagtggatgaactgaaaggaatcatggtcagaaacatagtctgtcaccttcaaaactaccagcagaaatcttgctcgagccatgtgtatgaagaacctcaagctcactattatcatcatcatcgtatcaattgtgttcatctatatcattgtttcacctctctgtggtggatttacatggccaagctgtgtgaagaaataggaaagaagaagttaccattaaccaaggatatgagagaacaaggagttaaaagcaatccatgtgactcaagcctttcacatactgacagatggtatctgccagtctcttcaaccctcttctcactttttaaaatcttgttccatgcctccaggtttatctttgtcttatctaccagtttattcctgtgaacttcagattgaaccattcattgcagcagtagccttaaaaaggcttttgtttatttctttggtttgttaactagtgtcatctatttagagaaacatttttgtttttaattgctcaaagctgtcgccgctagtcttatgagctatctactaaaactatggagaaactttgtatgtgcacacaaaagtattcaagagacagtattgctaacatctcatcttaatgtcttttgttattgagaagttttaggtgcttcaaaacaatataaatggataatagttgttatttggggaattgtaatgatgttggtgctgcttccttctaagagctcagacaagtaaagtatgaaacattcttatttcagttagatggggaacattttgctagcccattagaagcacacagaattatccttgtcctcctaatattgactttcaggaataaagttcagtgtgctgatcattcacaatacagtggatagcttgatatcttctgttttcccattgcagttgatttgagaagatgaaggtttaaatattgttgaaagttgcagttttttaaatgtgttcctttttcttctgtgaatatttagggcaatcgtgtcgctaatagaatatgtagtagagggggtggggaggtaaattcctctgacttgccaaagaaaaagaagggaaccacagtggatatgctagcattttagctgtgcaaagggaggtagtgtgggaaaagtgtttccattctgggaaaagcccaaaccgaatacggtcagcagtcaactccagggtttgggcttgattcctgttgaataatagttttgagcattctttgtggttaaataaattcttaaatctgcctagttttgatgaattcttttgtgaaacttgaaagagaatagacagtatgacatatagaattaatacaaaacagtttaacaaccatttaactgcagtgtaagaaaattggactgtaatcatatcgctactggcatctgttatctagtatgcatttctggtgtgtatctgaaaggaagacattttctaccctagatccaattgcatttatttatcaataagtgccattaaattgaaattatattacattttacactttctcaatgaatgaacaaattagtctgtagaatctagccacctgtttagcctagtcatgtgccttgaacatatatgtgtcccataatctggctcatggtacctgttcttctatccaaacctttcaattcatgctacctgattcatttatttgacatagatcttaggcccacttgaactcttttcttgtttatctagcatagcacaaacgtttttccagtcttctttatcaacactaatgcctcttaattgcatcagtatttcctattggaaaatacatctgttccagaaaaacatttggcattcctgaataatttccaaatgtttttaatccaaagaaaaaggtttaaagcttatttccctttcttatacacacctgaataaaattgatgtgcatgttttagggatcaattacctaactgttccttggtctatttatgtataagaatgctttttaaagcacatgtctcattttaaatgacgcacaaactgaagatgttaataaaatggaattc

SEQ ID NO: 116 - DNA, 1580 bp, Homo sapiens
gctatggcggtggacatcacgctgctattccgggccagcgtcaagaccgtgaagacgcggaacaaggcgctgggagtggcggtgggcggcggggtcgatggcagccgggacgagctgttccgccggagcccccggcccaagggcgacttctccagccgggcccgcgaagtgatttctcacattggcaaactgagagattttcttctggaacacaggaaagattatattaatgcttatagccataccatgtctgaatatgggaggatgacagacacagaacgagaccagatagaccaggatgcccagatattcatgaggacctgttcagaagcaattcagcaactacgaacagaagctcacaaggagatacattcccagcaagtgaaggagcacaggaccgctgttttggatttcattgaagattacttgaaaagagtatgtaaactttactcagaacagagagccatccgagttaaaagagtggtggataagaaaagattatctaagctggaaccagaaccaaatacaaagacaagagaatccacatcttctgagaaagtttcacagagtccttcaaaagactctgaagaaaaccctgccactgaagaacgtccagaaaaaattttggctgaaacacaacctgaattgggaacgtggggagatggcaaaggcgaagatgagttatccccagaagaaatacaaatgtttgaacaggaaaatcagcgactaattggtgaaatgaacagcttgtttgatgaagtgaggcaaatcgaagggagagtggttgagatttccagactccaagagatattcacggaaaaggttttgcaacaggaagctgagattgacagcattcaccagttagttgtgggggcaactgaaaatatcaaggaaggcaacgaagacataagagaggccattaaaaacaacgctggcttccgcgtgtggatcctcttcttcctcgtgatgtgctccttctccttgctcttcctcgactggtacgacagctagccagggccacgggggcccagcacgagagtcctcatgggcactcacagactgcgtgctttcatgtacttccagtgctggagcatggtatgaccagattttatcacagtgccatttgaagggaaaggagttcagacagacagacgtattccccaaaaagggataccccaggccgatggtgttcagccatttagcagctgaaaaaggaaacagtgcacaccaatgggaggcagcctgcgtagccctcatcaggcaagacagactgaatgcaggagtgggtgattagctgctccttgaacttgaggctgccttggcagcaggggcacagcaggcctcaagagcccctaattgtctcagggttcaaaggaagacactgacctttcccatcccggtagcttcagggaagatcatagttaataacgtctctcaacaaatgattacttctttgtttccttgtggcttcttgtctgtctgagtcaacgaatacacagacttactggattatagaagagaaaattcacatctgccttgttaatctaataaatataattacagccccttaaaaaaaaaaa

SEQ ID NO: 117 - DNA, 5530 bp, Homo sapiens
ggcggcccctgcagggcagctgaagccatggaagcctccgcaggtcgctgatcagggccaggcggctgcagcagcgactgcagaggcgctgcgccaagccgggccggagtggtgcgagccggcggggctgcggagggccagtggactcagggttgttgagaggagtcaatggcataatacgggaagccccgaaccacgggccaactgggaagttgatggtcggcgagaccagcccatcctaatttggggttcctggtcctgctccaggagtcctacagcctgcagcccctaccagagagggaggactgaacagcaagggggtgtgtgggtctgagtatcagggtcctggggaagaagcaggcctggctcgtagagtagaagactcggtgccggcagtcaggaggccctgctcctgaagcctctgtgaccttgggcacggccttcactctgtctggggcacattcactcatctggagaacacagggttggactgattacttttagccactcctgacagttgtggttttaagttgggtggtgggaacctgtgcaccagccctattcaattcactggtggaggcagccgtggtctgccaggccctcgctcctggggtgtcctgccgaagggtgagaagagaagccatgccgggcagcggccccagcgagaggatgacgtggcctggcccggccctttctgcgggccccccaacccgccctctctcctcagcccccgggataccgcccatcccaccccttactcggacccacagcctcatggccatgtccctgccaggaagtagacggacctctgctggatcacgcaggcgcacctctccacctgtgagcgtgcgggatgcctacggcacctcttcgctcagcagcagcagcaattctggctcctacaagggcagtgacagcagtcccacgccaaggcgctccatgaaatacacgctgtgcagtgacaaccatggcatcaagcccccgaccccggagcagtacctgacccccctgcagcagaaggaggtgtgcatccggcacctgaaagcccggctgaaggacacacaggaccggctccaggaccgggacacagagattgatgacctgaagacgcagctgtcacgcatgcaggaggactggattgaggaggagtgccaccgcgtggaggcccagctggccctgaaggaggcccgaaaggagatcaagcagctcaagcaggtcatcgacactgtcaagaacaacctgattgacaaggacaaggggctgcagaagtacttcgtggacatcaacatccagaacaagaagctggagacgctgctgcacagcatggaggtggcccagaatggcatggccaaggaggatggcactggggagtcagccggtgggtcccctgcccgctccctcacccgcagctccacctacaccaagctgagtgacccggctgtctgtggtgaccgccagccgggtgatccctccagcggctctgctgaggatggggcagacagtggctttgcagcagccgatgacacactgagccggacggacgcgctggaagccagcagcctgctgtcgtcgggggtggactgtggcaccgaggagacctcgctgcacagctccttcggcctgggcccccgcttccctgccagcaacacctatgagaagctgctgtgtggcatggaggctggtgtgcaggccagctgcatgcaggagcgtgccatccagacagacttcgtgcagtaccagcctgaccttgacaccatcctggagaaagtgacccaggcccaggtctgtgggacagaccctgagtcaggggacaggtgcccagagctggatgcccacccttcagggcccagagaccccaactcagcagtggtggtgacagtgggtgatgagctagaggccccagagcccatcacccgtggacccaccccacagcggcctggtgccaaccccaaccctggccagtcggtgagcgtggtgtgccccatggaagaggaggaggaggctgccgtggctgagaaggagcccaagagctactggagccgccactacatcgtggatctgctggctgtggtggtgccggccgtgcccacggtggcctggctttgccgctcccagcggcgccagggccagcccatctacaacatcagctccctgctgcggggctgctgcactgtggccttgcactccatccgcaggatcagctgccgctcgctgagccagccgagtcccagcccagcgggcggcggctcccagctctgagggggcccattccggcagcggcgcctgcggcctgaccactgattgtagggatgccgttcccccctcccttctcccatgggcatcatcttatttatttagttttgggtgtggaactgtttctttttttcaagatgttaaaacagtcccgtggaaggagcaggggttggagaaaggcatcccaaagcttcgatggagagcagggaagggggacccaaggcaggaggtacaccagctggacaaattgcagggaggggagggagcgagggccaacccggcccctctgtccccttggctcttcagacagggccagccctgctcaggaagtctctggctgtcttcatgtggggaagccgggcttgagttgcccataggcccctgccctgcaccatcctgtccagtgccctgcgcactccatgccgtctcttccaagccaccttgcccgcagcccaggctcctgggccagtgctctctcctcaaatggaggcagccatggcctgaagtgcagatcactgacccagggctcagagcagaggccagaaccactgggccggccggcattccagcctccccagactgctgcccaccttgggactcaggagctcagtcaaggccacaggctggaggagagacggggctgggcgcaaggtggcggagggcagtgtgggttctgtgtctgtctgttcatcccaggctttcccgtcatccctttcctcttggcacttctgggtgtgtcagtcattattcctgtgaggtagctaagcccggcaagctcagtgctggggtaggagggcctgcctgagtcccagctcccagctggagaatccaccagcacaagaagaggaggcaggggcagaaacccaagggggctcccccagccttccaaggtgaggccatctcatctgcaggctgggaggcagggctggactcaggaacccacagcttactgaaaaagccagaggccatgactgcccccagaaacttgccccgagtttctctggggccctcgggcccaacttctgctttgcactatgttcactttggggttggttctcagccatccaagggtctccagtgaggtggctgcttgctgtctgagatgagggttcctaaaccttaaacctctctgcctctggaggagggtggggtattctggcaggatgaatcgcaggatggcgcgtactgaagccacgatgttcatccaggccaaagcagggtgtcctgggataggtttcctaggcaggggcgtggcagagcaggtaggcgccctgcaccctccctgctcccagcccaaggccagtcggcctgggaagttcactgccccaactcttttcccgggaccatactgagtcccccagccacgctgctgacattaccattattattttaccaagtaaactcactccttttcccccacaggggttacacccatctggttgtcccacccactcttcagaggctaggccccacctctgggggttggagggaccctgtgtcttactcgcccctctggcctaagggccactctggttatctgccaaggttgcttgccctcaccccaatgctccaacagccattgcctaactcatgggctctgcccttctgctcggtgccctccacgtgaggcggggcacctgcatgcactgggagggggcggctggcccagccctcggggcaggagccccctctgccacacgctttgtgcctccaaagctccccccgccttggtcagggcctcagaccagccaacctttgtggaataagccccagcccagccaaaccaaacccagatgcctgaggcctggctggggctgcccccgcaggacactgtggccatgccacggagggggcagtggacaaaaccaatccaaagccaagccgggactggctgcggacccagcctcctgtgccgcgcactcacggagctgcgtagtctcctcagacatagtcaaagctttgccgagaaaagaaatgtatgaactatatttgacaacataaaatctctctatttttcaccactggaatttagtcaagcttcaggcccctctgctcctgtctgtgtcttgcgtctgtggccttcctattgtgtcttgtgttttggtggatgtgacagggctggggccacagtctactctgtctctgctgctagagaagccacctgtggaggactgggctgtggttgggcctgaggcctgtggaggaggtgagtgtagccagcagcggccgtctactcctgttctggcctgagaccaccggtgtgggtcacgaggaccctggcccacagtgttgagggtcctctctttcgggggctctcctggggccttcgatgggcttttcttcttgtcagtggagggagcagctccccactcagccctgggacaggccctgggactgtggtggccggtggccctggcccagctctggagtgcatgtgtgtgtgctcagatcccgcatctatgcaaaggtgcaggctgcctgtgaggctccaggcggtggaggtgcggcagctgctgctcaggtgccatgccctgaagaggcagggtacacatggggctgggagggcaaagatggggcggggcctccccctgagagagctcaccctccacagtgacccttttccttcctgcctaatacctcctcccgttgggctgtgacttttcctcctgccctcagcctctgaaacagaaatctttggggcctcccctttccccagcgtctggcaagagctgatgaggtcctgaggaacagtgtccccaggaaccaccttctggagcctagcggccagacgtggcttctcctgagttctagggctcgggccagagtggcactactgcccggccagtccaggctcaggcaggaatcggacgctggggcccgggctctgcacagagagctgggcttgagtggagtttattgtagatttctcccaaggggatcacttagcttctcactgacacacccttcccaattgccacaagcgcaggggtatcttacagcactttggggaggggtgggacaaactgcaaggttctggggccaaggcctacccaggggcctctgcccagagaactcacaaccccctctctgacctaggggacaatgcaaacaggtcacagtgcattcccatattaggccatccccttcacgaagaattcaggggatgtgggaagtggggaggcggggagggatcttgactcttgtctcctttgtccttttgttcagacagagttgtacctgcagcagacaactctgaattaaagcatgaaaacacagc

SEQ ID NO: 118 - DNA, 411 bp, Homo sapiens
atggcgggggctggttccgccgctgtatcgggggcagggaccccggtggcggggcccacaggccgcgaccttttcgccgaagggctgctggagttcctgcgacccgctgtgcagcagctcgactctcacgtacacgccgtcagagagagccaggtagagctccgggaacaaattgacaacctagccacagaactgtgccgcataaatgaggatcagaaggtggccctggatcttgacccctatgttaagaagctacttaatgcccggcgacgcgttgtcttggttaacaacattctacagaatgctcaggaacgactgagacggctaaaccacagtgttgccaaggaaacagcccgcaggagagcaatgctggattcgggaatttacccccctggctccccaggcaaataa

SEQ ID NO: 119 - DNA, 2490 bp, Homo sapiens
agctcgcgcgcctgcaggtcgacactagtggatccaaagaattcggcacgagggaagatggcgccgccggtggcagagagggggctaaagagcgtcgtgtggcagaagataaaagcaacagtgtttgatgactgcaagaaagaaggcgaatggaagataatgcttttagatgaatttaccactaagcttttggcatcgtgttgcaaaatgacagatcttctagaagaaggtattactgttgtagagaatatttataagaaccgtgaacctgtcagacaaatgaaagctctttatttcatcactccgacatcaaagtctgtagattgtttcttacatgattttgcaagtaaatcggagaacaagtataaagcagcatatatttacttcactgacttttgccctgataatctctttaacaaaattaaggcttcttgctccaagtcaataagaagatgtaaagaaataaatatttccttcattccacatgaatctcaggtgtatactcttgatgtaccagatgcattctattactgttatagtccagaccctggtaatgcaaagggaaaagatgccattatggaaacaatggctgaccagatagttacagtgtgtgccaccttggatgaaaatcccggagtaagatataaaagtaaacctctagataatgccagtaagcttgcacagcttgttgaaaaaaagcttgaagactactacaagattgatgaaaagagcctaataaagggtaaaactcattcacagctcttaataattgatcgtggctttgatcctgtgtccactgtcctgcatgaactgacctttcaggcaatggcatatgatctactaccaattgagaatgatacatacaaatataaaacagatggaaaagaaaaggaggccatccttgaagaagaagatgacctctgggttagaattcgacatcgacatattgcggttgtgttagaggaaattcccaagcttatgaaagaaatttcatcaacaaagaaagcaacagaaggaaagacatcacttagtgctcttacccagctgatgaaaaagatgccccatttccgaaaacagattactaagcaagttgtccatcttaacttagcagaagattgcatgaataagttcaagcttaatatagaaaagctctgcaaaactgaacaggacctggcacttggaactgatgcagaaggacagaaggtgaaagattccatgcgagtactccttccagttctactcaacaaaaatcatgataattgtgataaaataagagcaattctactttatatcttcagtattaatggaactacggaagaaaatttggacaggttgatccagaatgtaaagatagaaaatgagagtgacatgattcgtaactggagttaccttggtgttcccattgttccccaatctcaacaaggcaaaccgttaagaaaggatcggtctgcagaagaaacttttcagctctctcggtggacaccttttatcaaagatattatggaggatgctattgataatagattagattcaaaagaatggccatattgttcccagtgtccagcagtatggaatggttcaggagctgtaagtgctcgccagaaacccagagctaattatttagaagaccgaaaaaatgggtcaaagctgattgtttttgtaattggagggatcacatactctgaagtgcgttgtgcttatgaagtttctcaggcacataaatcctgtgaagttattattggttctacacatgttttaacacccaaaaagctgttggatgatataaagatgctgaataaacccaaggataaagtctccttaattaaagatgaatagcatttctttttggagggtttagagattcttactaatatgttgaactaaaatagaaagaaaatgttgctgtcatgtaatttaaacaatgtaaatattttatggaataatggcttttcaaatacatttcttaaggaactgtttatgattattactggatttgtcatttttgataatttaaatattgctgctgctttgtagatgatgagaagaaatgttaaagtgctttctaaaaggaaattttttcacctttggaggagaatatattagagttgtgggtaatttttcacagccacctatgtacatactaattacccattggatacttatatctaaaagtctcatgctgaagtatagtttttgggaaagaatgattttaaataaagagattgtaaaagtaaaaaactgtaaatgtatatgtatgatagaattgtttcctctaagtgtagtttttctttcaactaaaattcagtttatgtgtaaaataattcagtcattaatagaaatggagtgatttcacagtgtgtactgttttgccacatacttctaaagaacacaattttatataattttgaaatcatgtatgtttaaattagaaaaccaaaaatcatgaacattctaagagaaaataaatatagaatttaaaaaattaaaaaa

SEQ ID NO: 120 - DNA, 980 bp, Homo sapiens
gcacgagcaaagatggcggcagggaccagcagttactgggaagatctcaggaaacaggctcgacagctggaaaatgaacttgacctgaaactagtttccttcagcaaactatgtacaagttacagtcatagcagtacccgagatggaagacgcgacaggtatagttctgatacaacaccccttttaaatggatcaagccaagacagaatgtttgagacaatggcgattgagattgaacaacttttggcaaggcttacaggggtaaatgataaaatggcagaatataccaacagtgcaggtgtcccctccttgaatgcagccctgatgcatacattacagcggcatagagacatattgcaggattatacacatgaattccataaaaccaaagcaaactttatggcaatacgggaaagggagaatcttatgggatcagtacgaaaagatattgagtcatataaaagtgggtctggagtaaacaacagaagaactgagctatttttgaaagaacatgaccaccttcgaaactcagatcgtctgatagaagagacaataagcattgctatggcaacaaaagaaaatatgacttcacagagaggaatgttgaagtcaattcacagcaaaatgaacactttggccaatcgttttcctgctgtaaacagcctgatccagaggatcaacctgaggaagcggcgggactcgctcatcctagggggtgttattgggatctgtaccatcctgttgctgctgtatgcgttccattgatgggacatcttcagggactcttgacagccaccgctttcacaccctggtctggaataaggaaacatcggagggagaagttgactgtcttgataattagcctgaccagcaggatgaatgcaagactgacagtgatggactctgtgacatggtcaggttgagctgaagccacagtttctctgtgctgtgttttctaacacatttttctgtttttaatt

SEQ ID NO: 121 - DNA, 864 bp, Homo sapiens
atgaaagaccggctagcagaacttctggacttgtccaagcaatatgaccagcagttcccagacggggacgatgagtttgactcgccccacgaggacatcgtgttcgagacggaccacatcctggagtccctgtaccgagacatccgggacattcaggatgaaaaccagctgctggtggccaatgtgaagcggctgggaaagcagaacgcccgcttcctcacgtccatgcggcgcctcagcagcatcaagcgcgacaccaactccatcgccaaggccatcaaggccccccccgaggtcatccactgcaacgtgcgcgccatgaaggagctgagcgaggcggctgaggcccagcacggcccagcactcggcagtggcggcatttcgcgggcgcagtacaacgcgctcaccctcaccttccagcgcgccatgcacgactacaaccaggccgagatgaagcagcgcgacaactgcaagatccgcatccagcgccagctggagatcatgggcaaggaagtctcgggcgaccagatcgaggacatgttcgagcagggtaagtgggacgtgttttccgagaacttgctggccgacgtgaagggtgtgcgggccgccctcaacgagatcgagagccgccaccgcgaactcgtgcgcctggagagcgccatccgcgacgtacacgagctcttcttgcagatggcggtgctggtggagaagcaggccgacaccctgaacgtcatcgagctcaacgtacaaaagacggtcgactacaccggccaggccaaggcgcaggtgcggaaggccgtgcagtacgaggagaagaacccctgccggaccctctgctgcttctgctgtccctgcctcaagtag

SEQ ID NO: 122 - DNA, 1507 bp, Homo sapiens
ctcgaggccacgaaggccccgacaccatgtcctgccgggatcggacccaggagtttctgtctgcctgcaagtcgctgcagacccgtcagaatggaatccagacaaataagccagctttgcgtgctgtccgacaacgcagtgaattcaccctcatggccaagcgcattgggaaagaccttagcaacacatttgccaagctggagaagctgacaatcttggcaaagcgcaagtccctctttgatgataaagcagtggaaattgaagagctaacatatatcatcaaacaggacatcaatagcctcaacaaacaaattgctcagctccaggatttcgtgagagccaagggcagccagagtggccggcacctgcagacccactccaacaccattgtggtctccttgcagtcgaaactggcttctatgtccaatgacttcaaatcggttttagaagtgaggacagagaacctgaagcagcagaggagccggagagagcagttctcccgggcacctgtgtcagccctgccccttgcccctaaccacctgggcggtggtgctgtggttctgggggcagagtcccatgcctccaaggatgtcgccatcgacatgatggactctcggaccagccagcagctgcagctcattgacgagcaggattcctacatccagagtcgggcagacaccatgcagaacattgagtcgacaattgttgagttgggctccatctttcagcagttggcacacatggttaaggaacaggaggaaaccattcagaggatcgacgagaacgtgctaggagcccagctggacgttgaggccgcccattcagagatcctcaagtacttccagtctgtcacctccaaccggtggctcatggtcaaaatcttcctcatcctcattgtcttcttcatcatctttgtggtcttccttgcttgaaccctctctactctgaggcactctgttggggtttgggaccctcctgggaaggcaagtggccagtgctgccactgagcctgtgcagggtacttgggagaaaggccctgtttccctggaactgctaagaatgaccactgcccctgatcccccaccccttgcctctggccaccctgtcctccccccaccaccctcaggcctatgaaacacacagggttctagatttgaactctgctgtgaagtgactggaagggagcagaggccagctgggggccagtgggggaggttgtttccactaggagatttttataaaccctctccagcctctcccggaaaggaagcgttggcagcaaagggagatgatgcccttacccaccttcctgtgagtgaagagaggaagcagccccagggaccaattttcccaattgacctctttcttcctctttcaccatgtgaggcagggagccctgagcccttcagctgcctgcacaacccctgacattggctgctggtgactcaatctgccaaatgtgctgcagctcgttttctcccaattacagcaagactgtcagcctcca

SEQ ID NO: 123 - DNA, 1614 bp, Homo sapiens
gagggagccgtggaggtccaggtgactgcttagaaaactgcacagcatctgatgaaattagcgaataagaacatcaaccatgtcttacactccaggagttggtggtgaccccacccagttggcccagaggatctcttctaacatccagaagatcacacagtgttctgtggaaatacaaagaactctgaatcaacttggaacacctcaagattcacctgaattgaggcaacagttgcaacagaagcagcagtatactaaccagcttgccaaagaaacagataagtacattaaagagtttggatctctgcccaccacccccagtgaacagcgtcaaaggaaaatacagaaggatcgcttagtggcagagttcacaacatcactgacaaacttccagaaggtccagaggcaggctgctgagcgagagaaagagtttgttgctcgagtaagagccagttccagagtgtctggcagttttcctgaggacagctcaaaagaaaggaatcttgtatcctgggaaagccaaactcaacctcaagtgcaggtgcaggatgaagaaattacagaggatgacctccgtcttattcatgagagagaatcttctatcaggcaacttgaagctgatattatggatattaatgaaatatttaaagatttgggaatgatgattcatgaacaaggagatgtaatagatagcatagaagccaatgtggaaaatgcagaggtgcacgttcagcaagcaaatcagcagctgtcaagggcagcagattatcagcgcaaatccagaaaaaccctgtgcatcatcattcttatccttgtcattggagttgcgattatcagtctcatcatatggggattgaaccactgaagttataaaggagcacactgtcgcactacattgtctaaattatgtaggaagattcctgtaatcatgtttttttaattattattttaaagctattgtataaaggatggttcccatactttgttatttttattgggggggttgggcgggttcctttggattaaatctgatattttctaatactgaaagattttctaaatgtcactgctgacataactcccttggtcttcaatttaatagttgttaagttttgggccacattgcatatgcctttcatttataatttatttaccctgcttgacttagtttggggaattcggaaatttaaggtgtgtgtattctgttgggatctccctgccacgtgaacacaccaagatgtgtgttacttcaagttaaaactccccaaaatttaatttttgatttgcttccaccaggggaaaatattctccaataatgtaaaataattaaggtccaatacatgggttgtatttttctggttcacaacagcacaaagtgtctttcatttttttgttggatttcctttaagatcttttttaccctgaagtcggtgaacacttttctagttaatttgatactctttctgtgtatataataagcttttgctgtagattgcctagtaaaattactaaggataggttgtttttacatatggtctatttaagtctgatgtttacgggggagagtgtagttactaaaaatgtttaacataatttggaagaagagtatgaaca

SEQ ID NO: 124 - DNA, 691 bp, Homo sapiens
accaacggtctccccctcccagcttcttacctcggcttcctactccttcccccgcccgcccagcaccgccagcccgggagagctgccgggagttccccgggagcgctgccgggagttccccgggagcctcaggtggtgactatcctgttgagaagcaaaagatactttgcaagtaaaaaatatgcctcccaagtttaagcgccacctcaatgatgatgatgtcacaggttctgtgaaaagtgaaaggagaaatcttttggaagatgattcagatgaagaagaggacttttttctaaggggaccatctggaccaagatttggacctagaaatgataaaattaagcatgttcagaatcaagtggatgaagttattgatgtcatgccagaaaatattacaaaggtaattgagagaggggagagactagatgaactacaggacaaatcagaaagcttatcggataatgcaacagcttttagcaacagatccaaacaacttcgaaggcaaatgtggtggcgtggatgcaaaataaaagccatcatggctttggttgctgctatccttttgctagtgattatcattcttatagtcatgaaataccgtacttgatttgatgacagagatcttcattaacaagatctggacagtaataaagatgctgcataattaatgaactatgtgtatatacttcaa

SEQ ID NO: 125 - DNA, 924 bp, Homo sapiens
atggccaccaggcgtttaaccgacgctttcttgttgttgcggaataattccatccaaaaccggcagctgttagccgagcaagagctggacgagcttgctgatgaccgtatggcactggtgtcaggcatcagcttagatccagaagcagcgattggtgtgacaaaacggccacctcctaagtgggtggatggagtggatgaaattcagtatgatgttggccggattaagcagaagatgaaagaattggccagccttcatgacaagcatttaaacagacccaccctggatgacagcagcgaagaggaacatgccattgagataactacccaagagatcactcagctcttccacaggtgccagcgtgccgtgcagccctgccgagccgggaaagggcctgctccgagcaggaggggcggctgcttgggaacgtggtgcctcgtggcgcaggccctgcaggaactctccaccagcttccggcacgcacaatcaggctacctcaaacgcatgaagaatcgagaggaaagatcccagcattttttcgacacatcagtaccactaatggatgatggagacgataacactctttaccatcggggttttacagaggaccagttagttctggtggagcagaacacactgatggtggaagagcgggaacgagagattcgccagattgtacagtccatttctgacctgaatgaaatattcagggacttaggggcgatgattgtagaacagggtacagtccttgacagaattgactataacgttgaacagtcctgtatcaaaactgaagatggtttgaaacagcttcacaaggcagaacagtatcaaaagaagaatcggaagatgcttgtgattttaatattatttgtcatcatcattgtgctcattgttgtcctcgttggcgtgaagtctcgataa

SEQ ID NO: 126 - DNA, 750 bp, Homo sapiens; identical to SEQ ID NO: 56

SEQ ID NO: 127 - DNA, 895 bp, Homo sapiens
atgcgcgacaggacccacgagctgagacagggggatgacagctcggacgaagaggacaaggagcgggtcgcgctggtggtgcacccgggcacggcacggctggggagcccggacgaggagttcttccacaaggtccggacaattcggcagactattgtcaaactggggaataaagtccaggagttggagaaacagcaggtcaccatcctggccacgccccttcccgaggagagcatgaagcaggagctgcagaacctgcgcgatgagatcaaacagctggggagggagatccgcctgcagctgaaggccatagagccccagaaggaggaagctgatgagaactataactccgtcaacacaagaatgagaaaaacccagcatggggtcctgtcccagcaattcgtggagctcatcaacaagtgcaattcaatgcagtccgaataccgggagaagaacgtggagcggattcggaggcagctgaagatcaccaatgctgggatggtgtctgatgaggagttggagcagatgctggacagtgggcaaagcgaggtgtttgtgtccaatatcctgaaggacacgcaggtgactcgacaggccttaaatgagatctcggcccggcacagtgagatccagcagcttgaacgcagtattcgtgagctgcacgacatattcacttttctggctaccgaagtggagatgcagggggagatgatcaatcggattgagaagaacatcctgagctcagcggactacgtggaacgtgggcaggagcacgtcaagacggccctggagaaccagaagaaggcgaggaagaagaaagtcttgattgccatctgtgtgtccatcaccgtcgtcctcctagcagtcatcattggcgtcacagtggttggataas

SEQ ID NO: 128 - DNA, 639 bp, Homo sapiens
atggatcccctgttccagcaaacgcacaagcaggtccacgagatccagtcttgcatgggacgcctggagacggcagacaagcagtctgtgcacatagtagaaaacgaaatccaagcaagcatagaccagatattcagccgtctagaacgtctggagattttgtccagcaaggagccccctaacaaaaggcaaaatgccagacttcgggttgaccagttaaagtatgatgtccagcacctgcagactgcgctcagaaacttccagcatcggcgccatgcaagggagcagcaggagagacagcgagaagagcttctgtgtcgaacgttcaccactaacggctctgacaccaccataccaatggacgaatcactgcagtttaactcctccctccagaaagttcacaacggcatggatgacctcattttagatgggcacaatattttagatggactgaggacccagagactgaccttgaaggggactcagaagaagatccctgacattgccaacatgctgggcttgtccaacacagtgatgcggctcatcgagaagcgggctttccaggacaagtactttatgataggtgggatgctgctgacctgtgtggtcatgttcctcgtggtgcagtacctgacatga

SEQ ID NO: 129 - DNA, 1903 bp, Homo sapiens
gggacgcgctacctgcctccgggcgcctgggcttcaggatgaaggaccgtctggagcagctgaaggccaagcagctgacacaggatgatgatactgatgcggttgagattgctatcgacaacacggcttttatggacgagttcttttctgagattgaggaaactcggcttaacattgacaagatctcagaacatgtagaggaggctaagaaactctacagtatcattctctctgcaccgattccagagccaaaaaccaaggatgacctagagcagctcacgactgagattaagaaaagggccaacaacgtccggaacaaactgaagagcatggagaagcatattgaagaagatgaggtcaggtcatcggcagaccttcggattcggaaatcccagcactctgtcctttctcggaagtttgtggaggtgatgaccaaatacaatgaagctcaagtggacttccgagaacgcagcaaagggcgaatccagcggcacgtcgaaattactggcaaaaagacaaccgatgaggagctggaggagatgttggagagtggcaacccggccatcttcacttctgggatcattgactcacagatttccaagcaagccctcagtgagattgagggacgacacaaggacattgtgaggctggagagcagcatcaaggagcttcacgacatgtttatggacatcgccatgctggtggagaatcagggtgagatgttagataacatagagttgaatgtcatgcacacagtggaccacgtggagaaggcacgagatgaaagcaaaaaagctgtgaaataccagagtcaggcccggaagaaattgataattatcattgtgctagtagttgtgttgctgggcattttagcattgattattggactttccgttgggctgaattaagagtggcctaagaggctgctgcactgaaataaactgatttcactccagactggtgtggccacccttgtcttcagatgagaatggagtctgaatggccttcctgagagcgagtgcgacccgttcctttgtttccttgcaaccacccttggacctgactcagctaacaatctagccctgggggaatgtgatctacctgatgcgaccctgagttctccccagagcctcctcctgccccaccagctctcaagtaccttttctcctggactgtgtggacccacccagctttcttcctccctgttgtgtgtcagattatgccttgcacttgggaaagctcttgtgagactctcccaaggtgctgtattttcctacctcaggagtattctccagaaactgcaatgtatttttttaggggagtatctttaacaaagcagaatgattcttctaagtttggcaacaagaaggcttggatctgagtcttctacctggcaggatgccaatcctgtttgttgtccgtatgtcctgaaaacatgagggactggcagatgtcattttggtctaaagagctgacttgtttgaaattcagccttaaattaagctcttagttgttcagcttggggggcaactttgatttttctctgtgttgtagtctctcatatttactcaaggaggaccaggatgatacagtcatctgaggttatgctttgcaaaaggctgacggtatggaatatgtttccatgtctgagtcttagaaactggctgctcattgttagaaagtgatgctttgtgagactattgtcttggggccaaaaataatcagggattttaaattgggcaagggagaaggtgctagaatcctaagctctggaaatatttcatgacactggtgtttcactcatgtgttccagatgtattctaattgtgtatgaaatgtatgtacacataagtgtgtgtgtctcaggaagtaggaaataaaaatggaagctattatgacctca

SEQ ID NO: 130 - DNA, 1248 bp, Homo sapiens
caagatatcgaattccaaatttgagggcctcccggctctggcgccggagggagagctcaggccgccatgcgcgacaggacccacgagctgagacagggggatgacagctcggacgaagaggacaaggagcgggtcgcgctggtggtgcacccgggcacggcacggctggggagcccggacgaggagttcttccacaaggtccggacaattcgtcagactattgtcaaactggggaataaagtccaggagttggagaaacagcaggtcaccatcctggccacgccccttcccgaggagagcatgaagcaggagctgcagaacctgcgcgatgagatcaaacagctggggagggagatccgcctgcagctgaaggccatagagccccagaaggaggaagctgatgagaactataactccgtcaacacaagaatgagaaaaacccagcatggggtcctgtcccagcaattcgtggagctcatcaacaagtgcaattcaatgcagtccgaataccgggagaagaacgtggagcggattcggaggcagctgaagatcaccaatgctggcatggtgtctgatgaggagttggatcagatgctggacagtgggcaaagcgaggtgtttgtgtccaatatccttaaggacacgcaggtgactcgacaggccttaaatgagatctcggcccggcacagtgagatccagcagcttgaacgcagtattcgtgagctgcacgacatattcacttttctggctaccgaagtggagatgcagggggagatgatcaatcggattgagaagaacatcctgagctcagcggactacgtggaacgtgggcaggagcacgtcaagacggccctggagaaccagaagaaggtgaggaagaagaaagtcttgattgccatctgtgtgtccatcaccgtcgtcctcctagcagtcatcattggcgtcacagtggttggataatgtcgcacattgttggcactaggagcaccaggaacccagggcctggccttctctcccagcagcctggggggcaggcagagcctccagtcggaccccttcctcacacactggcccctatgcagaagggcagacagttcttctggggttggcagctgctcattcatgatggcctcctccttcaggcctcaatgcctgggggaggcctgcactgtcctgattggccgggacacacggttttgtaaaaaattaaaaaacaaaaaaagagcatagaaaaaaaaaaaaccgagt

SEQ ID NO: 131 - DNA, 21 bp, Rattus norvegicus
tttctccgcgtccgccatggt

SEQ ID NO: 132 - DNA, 21 bp, Rattus norvegicus
tttcctcgcgtcccgcatggt

SEQ ID NO: 133 - DNA, 20 bp, Rattus norvegicus
ggcaatcctacaggttccag

SEQ ID NO: 134 - protein, 277 aa, Homo sapiens [sequence omitted]

SEQ ID NO: 135 - protein, 277 aa, Homo sapiens
MEAAETEAEAAALEVLAEVAGILEPVGLQEEAELPAKILVEFVVDSQKKDKLLCSQLQVADFLQNILAQEDTAKGLDPLASEDTSRQKAIAAKEQWKELKATYREHVEAIKIGLTKALTQMEEAQRKRTQLREAFEQLQAKKQMAMEKRRAVQNQWQLQQEKHLQHLAEVSAEVRERKTGTQQELDRVFQKLGNLKQQAEQERDKLQRYQTFLQLLYTLQGKLLFPEAEAEAENLPDDKPQQPTRPQEQSTGDTMGRDPGVSFKAVGLQPAGDVNLP

SEQ ID NO: 136 - protein, 277 aa, Homo sapiens; identical to SEQ ID NO: 135

SEQ ID NO: 137 - protein, 230 aa, Homo sapiens
MEAAETEAEAAALEVLAEVAGILEPVGLQEEAELPAKILVEFVVDSQKKDKLLCSQLQVADFLQNILAQEDTAKGLDPLASEDTSRQKAIAAKEQWKELKATYREHVEAIKIGLTKALTQMEEAQRKRTQLREAFEQLQAKKQMAMEKRRAVQNQWQLQQEKHLQHLAEVSAEGKLLFPEAEAEAENLPDDKPQQPTRPQEQSTGDTMGRDPGVSFKAVGLQPAGDVNLP

SEQ ID NO: 138 - protein, 277 aa, Homo sapiens [sequence omitted]

SEQ ID NO: 139 - protein, 277 aa, Homo sapiens [sequence omitted]

SEQ ID NO: 140 - protein, 230 aa, Pan troglodytes
MEAAETEAEAAALEVLAEVAGILEPVGLQEEAELPAKILVEFVVDSQKKDKLLCSQLQVADFLQNILAQEDTAKGLDPLASEDTSRQKAIAAKEQWKELKATYREHVEAIKIGLTKALTQMEEAQRKRTQLQEAFEQLQAKKQMAMEKRRAVQNQWQLQQEKHLQHLAEVSAEGKLLFPEAEAEAENLPDDKPQQPTRPQEQSTGDTMGRDPGVSFKAVGLQPAGDANLP

SEQ ID NO: 141 - protein, 281 aa, Pan troglodytes
MEAAETEAEAAALEVLAEVAGILEPVGLQEEAELPAKILVEFVVDSQKKDKLLCSQLQVADFLQNILAQEDTAKGLDPLASEDTSRQKAIAAKEQWKELKATYREHVEAIKIGLTKALTQMEEAQRKRTQLQEAFEQLQAKKQMAMEKRRAVQNQWQLQQEKHLQHLAEVSAEVRERKTGTQQALEGVFQKLGNLKQQAEQERDKLQRVSCCSLRLRLRQRIFQMINPSSRLDPRSRVQETPWGETLVCPSRLSVYNLLEMQICHDFLEDSSMEKDPRKGL

SEQ ID NO: 142 - protein, 277 aa, Pan troglodytes
MEAAETEAEAAALEVLAEVAGILEPVGLQEEAELPAKILVEFVVDSQKKDKLLCSQLQVADFLQNILAQEDTAKGLDPLASEDTSRQKAIAAKEQWKELKATYREHVEAIKIGLTKALTQMEEAQRKRTQLQEAFEQLQAKKQMAMEKRRAVQNQWQLQQEKHLQHLAEVSAEVRERKTGTQQALEGVFQKLGNLKQQAEQERDKLQRYQTFLQLLYTLQGKLLFPEAEAEAENLPDDKPQQPTRPQEQSTGDTMGRDPGVSFKAVGLQPAGDANLP

SEQ ID NO: 143 - protein, 266 aa, Rattus norvegicus
MADAEKNAVAEKNAVAEENAVAEENAVADKNATKEVLAEAASVLEPVGLPEEAELPAKIMEEFMRNSRKKDKLLCSQLQVVNFLQTFLAQEDNTDQNPDALASEDTSRQKATETKEQWKELKATYMDHVDVIKCALSEALPQVKEAHRKYTELQKAFEQLEAKKRVLEEKLQLAQKQWVLQQKRLQNLTKISAEVKRRRKRALEKLDGSHQELETLKQQAGQEQEKLQRNQSYLQLLCSLQNKLVISESKADDKDVKGPALPPKSP

SEQ ID NO: 144 - protein, 266 aa, Rattus norvegicus; identical to SEQ ID NO: 143

SEQ ID NO: 145 - protein, 266 aa, Rattus norvegicus; identical to SEQ ID NO: 143

SEQ ID NO: 146 - protein, 252 aa, Mus musculus
MADAEKNAVAEKNNAVATKEVLAEAAAILEPVGLQEEAELPAKIMEEFMRNSRKKDKLLCSQLQVVNFLQTFLAQEDTEQSPDALASEDASRQKATETKEQWKDMKATYMDHVDVIKCALSEALPQVKEAHRKYTELQKAFEQLEAKKRVLEEKLQLAQKQWVLQQKRLQNLTKISAEVKRRRKRALEKLDGSHQELETLKQQAGQEQEKLQRNQSYLQLLCSLQNKLVISEGKAEDKDVKGRALTAKSKSP

SEQ ID NO: 147 - protein, 252 aa, Mus musculus; identical to SEQ ID NO: 146

SEQ ID NO: 148 - protein, 252 aa, Mus musculus; identical to SEQ ID NO: 146

SEQ ID NO: 149 - protein, 252 aa, Mus musculus; identical to SEQ ID NO: 146

SEQ ID NO: 150 - protein, 286 aa, Bos taurus
MGAAESEVETAAREVLAKVADIQEPVGFQEEAELPAQILAEFVMDSRKKDKLLCSQLQVVDFLQNFLVQEGTAQDQNPLASEDTSRQKALEAKEQWKELKATYQEHVEVITNSLTEALPKVEEAQIKQAQLQEALKQLQAKKQMAMEKLRIAQKQWQLEQEKHLQNLAEASSEVRERQTGAQQELQRLYQELGTLKQQAGQEKDKLQRHQTFLQLLYTLQGKQLFNEAEAEIPQELDLPKDKLQQVTQPQEQNTQDTMGREADNPQPVGDAGLPWLPGRQQHKEES

SEQ ID NO: 151 - protein, 286 aa, Bos taurus; identical to SEQ ID NO: 150

SEQ ID NO: 152 - protein, 239 aa, Bos taurus
MGAAESEVETAAREVLAKVADILEPVGFQEEAELPAQILAEFVMDSRKKDKLLCSQLQVVDFLQNFLVQEGTAQDQNPLASEDTSRQKALEAKEQWKELKATYQEHVEVITNSLTEALPKVEEAQIKQAQLQEALKQLQAKKQMAMEKLRIAQKQWQLEQEKHLQNLAEASSEGKQLFNEAEAEIPQELDLPKDKLQQVTQPQEQNTQDTMGREADNPQPVGDAGLPWLPGRQQHKEES

SEQ ID NO: 153 - protein, 110 aa, Macaca fascicularis
MEEAQRKRTQLQEAFEQLQAKKQVAMEKRRAAQNQWQLQQEKHLQHLAKVSAEGKLLFPEAEAEAENLPDDKPQQLTRPQEQSTGDTMGRDAGVSFKAVSLQPAGDANLP

SEQ ID NO: 154 - protein, 110 aa, Macaca fascicularis; identical to SEQ ID NO: 153

SEQ ID NO: 155 - protein, 277 aa, Macaca fascicularis
MEAAETEAEAAALEVLAEVAGILEPVGLQEEAELPAKILVEFVVDSQKKDKLLCSQLQVVDFLQNILAQEDTAKGLDPLASEDTSRQKAIAAKEQWKELKATYREHVEAIKIGLTKALTQMEEAQRKRTQLQEAFEQLQAKKQVAMEKRRAAQNQWQLQQEKHLQHLAKVSAEVRERKTGTQQELEGVFQKLGNLKQQAEQEQDKLQRYQTFLQLLYTLQGKLLFPEAEAEAENLPDDKPQQLTRPQEQSTGDTMGRDAGVSFKAVSLQPAGDANLP

SEQ ID NO: 156 - protein, 338 aa, Equus caballus
MEVAETKAEAAALETLAEVADILEPRGLQEEAEVPAQILAEFVTDSRKKDKLLCSQLQVVDFLQNFLAQEDTAQGLDPLASEDTSRQKAIAAKEQWKELKATYQEHVEAITSALTQVLPKVEEAQRKRAQLQEALEQLQAKKQVAAEKLRVAQKQWQLQQEKHLQHLAEVSAEVRERQTGMKQELERLYQELGTLKQEAGQEREKLQRHQTFLQLLYTLQGKLLLPEAEAELPQERDLPEPKSQQVTQSWELNTGDTMERVGDVSSKELDFEDSLKSGTRVGSRVEGGVGLASRVWGCSWVQWGDPRAGYTQRSVGKSPIEVLKQAGRNMFLQFTLIF

SEQ ID NO: 157 - protein, 274 aa, Ornithorhynchus anatinus
MAILASQDGREEAEAEVPAKLLAEFVMDSRKKDKLLCSQLHVVQFLQDFLEHMDAAPGFHISEEEIRKEANEAKQKWKDLKGDYQELVEKIEEAMPRVLQQVEALQKKRELLEEALSEYQMQKHSTEEKLRAVQEQKQRDQNCRAMGVMNEFPLDWKQQEWQLRYLKPSCVCTLAVQPGLLGSSSLEAVRLISVEGLPNPPDLLLYKGPGGVRPCDPNSADPKSLNMGPSLRGAYGKEQQELVIYGAKPSVVFLGQEDWQNGVTIEAPRVSSSG

SEQ ID NO: 158 - protein, 194 aa, Monodelphis domestica
MAADVTARAAAVAEALASAAATLEAPSVQEDVSSALLAEFLKDSRKKEKLLWGQLQVVDALQSFLEHMDEAVNPEEEIRAEVSAAHRLWKDLKAEYLKQTEAVEAALLQALVQLEAGQRKQLLLRSTLQQIQTKGRALEEWRSRAQTWRRQEQEKRRQELTARAQAQRERLENGGQQQEQVLMLQGQETQSAQR

SEQ ID NO: 159 - protein, 286 aa, Canis familiaris
MAEAEVGARAQALEALAALGDILEPVGRQEEVELPAQILAEFVMDSRKKDKLLCSQLQVVDFLQNFLAQEGIVQGLDPLASEDTSRQKALAVKEQWKELKATYQEHVEAITGALTQALAKTEEAQSKRVQLQEALEQLQAKKQVAMERARTAQKQWQLQQEKRLQHLAEASAEVRQRQRGAQQELERLRQELGALQQQAGQKRDRLQRHQTFLRLLHILQGEPLLPGAETERPQELGIPEAKPREQNTGDAVGKDRSVPSQADGLQPARGTSSRWFPEGQQHGKGT

SEQ ID NO: 160 - protein, 294 aa, Sus scrofa
MEAAETKAEAAAREALAKVADILEPTGLQEEAELPAQILAEFVMDSRKKDKLLCSQLQVVDFLQNFLIQEDTAQGLDPLASEDTSRKRAIEAKEQWKELKATYQEHVEAITSALTQALPKMEEAQKKQAQLQETLEQLQAKKQVAVEKLRIAQKQWQLQQEKHLQHLTKVSAEVKERQMGTQQEFERLYQELGALKQQARQEQDKLQRHQTFLQLLYTLQGKLLFSEAEAEAQIPQELNLPKDKPLQLTQPQEQNPQDIMGRDGSVSSKVDSPQPIGDASLPWLPGAQQHGEGS

SEQ ID NO: 161 - protein, 261 aa, Homo sapiens
MSYTPGVGGDPAQLAQRISSNIQKITQCSVEIQRTLNQLGTPQDSPELRQQLQQKQQYTNQLAKETDKYIKEFGSLPTTPSEQRQRKIQKDRLVAEFTTSLTNFQKVQRQAAEREKEFVARVRASSRVSGSFPEDSSKERNLVSWESQTQPQVQVQDEEITEDDLRLIHERESSIRQLEADIMDINEIFKDLGMMIHEQGDVIDSIEANVENAEVHVQQANQQLSRAADYQRKSRKTLCIIILILVIGVAIISLIIWGLNH

SEQ ID NO: 162 - protein, 160 aa, Homo sapiens
MDKLKKVLSGQDTEDRSGLSEVVEASSLSWSTRIKGFIACFAIGILCSLLGTVLLWVPRKGLHLFAVFYTFGNIASIGSTIFLMGPVKQLKRMFEPTRLIATIMVLLCFALTLCSAFWWHNKGLALIFCILQSLALTWYSLSFIPFARDAVKKCFAVCLA

SEQ ID NO: 163 - protein, 288 aa, Callithrix jacchus
MKDRTQELRTAKDSDDDDDVAVTVDRDRFMDEFFEQVEEIRGFIDKIAENVEEVKRKHSAILASPNPDEKTKEELEELMSDIKKTANKVRSKLKSIEQSIEQEEGLNRSSADLRIRKTQHSTLSRKFVEVMSEYNATQSDYRERCKGRIQRQLEITGRTTTSEELEDMLESGNPAIFASGIIMDSSISKQALSEIETRHSEIIKLENSIRELHDMFMDMAMLVESQGEMIDRIEYNVEHAVDYVERAVSDTKKAVKYQSKARRKKIMIIICCVILGIVIASTVGGIFA

SEQ ID NO: 164 - protein, 210 aa, Pan troglodytes
MSAKSAISKEIFAPLDERMLGAVQVKRRTKKKIPFLATGGQGEYLTYICLSVTNKKPTQASITKVKQFEGSTSFVRRSQWMLEQLRQVNGIDPNGDSAEFDLLFENAFDQWVASTASEKCTFFQILHHTCQRYLTDRKPEFINCQSKIMGGNSILHSAADSVTSAVQKASQALNERGERLGRAEEKTEDLKNSAQQFAETAHKLAMKHKC

SEQ ID NO: 165 - protein, 136 aa, Pan troglodytes
MAGAGSAAVSGAGTPVAGPTGRDLFAEGLLEFLRPAVQQLDSHVHAVRESQVELREQIDNLATELCRINEDQKVALDLDPYVKKLLNARRRVVLVNNILQNAQERLRRLNHSVAKETARRRAMLDSGIYPPGSPGK

SEQ ID NO: 166 - protein, 307 aa, Homo sapiens
MAALAPLPPLPAQFKSIQHHLRTAQEHDKRDPVVAYYCRLYAMQTGMKIDSKTPECRKFLSKLMDQLEALKKQLGDNEAITQEIVGCAHLENYALKMFLYADNEDRAGRFHKNMIKSFYTASLLIDVITVFGELTDENVKHRKYARWKATYIHNCLKNGETPQAGPVGIEEDNDIEENEDAGAASLPTQPTQPSSSSTYDPSNMPSGNYTGIQIPPGAHAPANTPAEVPHSTGVASNTIQPTPQTIPAIDPALFNTISQGDVRLTPEDFARAQKYCKYAGSALQYEDVSTAVQNLQKALKLLTTGRE

SEQ ID NO: 167 - protein, 100 aa, Homo sapiens
MEEASEGGGNDRVRNLQSEVEGVKNIMTQNVERILARGENLEHLRNKTEDLEATSEHFKTTSQKVARKFWWKNVKMIVLICVIVFIIILFIVLFATGAFS

SEQ ID NO: 168 - protein, 141 aa, Homo sapiens
MPPKFKRHLNDDDVTGSVKSERRNLLEDDSDEEEDFFLRGPSGPRFGPRNDKIKHVQNQVDEVIDVMQENITKVIERGERLDELQDKSESLSDNATAFSNRSKQLRRQMWWRGCKIKAIMALVAAILLLVIIILIVMKYRT

SEQ ID NO: 169 - protein, 258 aa, Homo sapiens
MSAYPKSYNPFDDDGEDEGARPAPWRDARDLPDGPDAPADRQQYLRQEVLRRAEATAASTSRSLALMYESEKVGVASSEELARQRGVLERTEKMVDKMDQDLKISQKHINSIKSVFGGLVNYFKSKPVETPPEQNGTLTSQPNNRLKEAISTSKEQEAKYQASHPNLRKLDDTDPVPRGAGSAMSTDAYPKNPHLRAYHQKIDSNLDELSMGLGRLKDIALGMQTEIEEQDDILDRLTTKVDKLDVNIKSTERKVRQL

SEQ ID NO: 170 - protein, 116 aa, Canis familiaris
MSATAATAPPAAPAGEGGPPAPPPNLTSNRRLQQTQAQVDEVVDIMRVNVDKVLERDQKLSELDDRADALQAGASQFETSAAKLKRKYWWKNLKMMIILGVICAIILIIIIVYFSS

SEQ ID NO: 171 - protein, 116 aa, Homo sapiens
MAGIELERCQQQANEVTEIMRNNFGKVLERGVKLAELQQRSDQLLDMSSTFNKTTQNLAQKKCWENIRYRICVGLVVVGVLLIILIVLLVVFLPQSSDSSSAPRTQDAGIASGPGN

SEQ ID NO: 172 - protein, 206 aa, Homo sapiens
MAEDADMRNELEEMQRRADQLADESLESTRRMLQLVEESKDAGIRTLVMLDEQGEQLDRVEEGMNHINQDMKEAEKNLKDLGKCCGLFICPCNKLKSSDAYKKAWGNNQDGVVASQPARVVDEREQMAISGGFIRRVTNDARENEMDENLEQVSGIIGNLRHMALDMGNEIDTQNRQIDRIMEKADSNKTRIDEANQRATKMLGSG

SEQ ID NO: 173 - protein, 206 aa, Mus musculus
MAEDADMRNELEEMQRRADQLADESLESTRRMLQLVEESKDAGIRTLVMLDEQGEQLERIEEGMDQINKDMKEAEKNLTDLGKFCGLCVCPCNKLKSSDAYKKAWGNNQDGVVASQPARVVDEREQMAISGGFIRRVTNDARENEMDENLEQVSGIIGNLRHMALDMGNEIDTQNRQIDRIMEKADSNKTRIDEANQRATKMLGSG

SEQ ID NO: 174 - protein, 220 aa, Homo sapiens
MAILFAVVARGTTILAKHAWCGGNFLEVTEQILAKIPSENNKLTYSHGNYLFHYICQDRIVYLCITDDDFERSRAFNFLNEIKKRFQTTYGSRAQTALPYAMNSEFSSVLAAQLKHHSENKGLDKVMETQAQVDELKGIMVRNIDLVAQRGERLELLIDKTENLVDSSVTFKTTSRNLARAMCMKNLKLTIIIIIVSIVFIYIIVSPLCGGFTWPSCVKK

SEQ ID NO: 175 - protein, 288 aa, Rattus norvegicus
MKDRTQELRSAKDSDDEEEVVHVDRDHFMDEFFEQVEEIRGCIEKLSEDVEQVKKQHSAILAAPNPDEKTKQELEDLTADIKKTANKVRSKLKAIEQSIEQEEGLNRSSADLRIRKTQHSTLSRKFVEVMTEYNATQSKYRDRCKDRIQRQLEITGRTTTNEELEDMLESGKLAIFTDDIKMDSQMTKQALNEIETRHNEIIKLETSIRELHDMFVDMAMLVESQGEMIDRIEYNVEHSVDYVERAVSDTKKAVKYQSKARRKKIMIIICCVVLGVVLASSIGGTLGL

SEQ ID NO: 176 - protein, 302 aa, Homo sapiens
MSEDEEKVKLRRLEPAIQKFIKIVIPTDLERLRKHQINIEKYQRCRIWDKLHEEHINAGRTVQQLRSNIREIEKLCLKVRKDDLVLLKRMIDPVKEEASAATAEFLQLHLESVEELKKQFNDEETLLQPPLTRSMTVGGAFHTTEAEASSQSLTQIYALPEIPQDQNAAESWETLEADLIELSQLVTDFSLLVNSQQEKIDSIADHVNSAAVNVEEGTKNLGKAAKYKLAALPVAGALIGGMVGGPIGLLAGFKVAGIAAALGGGVLGFTGGKLIQRKKQKMMEKLTSSCPDLPSQTDKKCS

SEQ ID NO: 177 - protein, 259 aa, Homo sapiens
MAASRLELNLVRLLSRCEAMAAEKRDPDEWRLEKYVGALEDMLQALKVHASKPASEVINEYSWKVDFLKGMLQAEKLTSSSEKALANQFLAPGRVPTTARERVPATKTVHLQSRARYTSEMRSELLGTDSAEPEMDVRKRTGVAGSQPVSEKQSAAELDLVLQRHQNLQEKLAEEMLGLARSLKTNTLAAQSVIKKDNQTLSHSLKMADQNLEKLKTESERLEQHTQKSVNWLLWAMLIIVCFIFISMILFIRIMPKLK

SEQ ID NO: 178 - protein, 276 aa, Homo sapiens
MSYGPLDMYRNPGPSGPQLRDFSSIIQTCSGNIQRISQATAQIKNLMSQLGTKQDSSKLQENLQQLQHSTNQLAKETNELLKELGSLPLPLSTSEQRQQRLQKERLMNDFSAALNNFQAVQRRVSEKEKESIARARAGSRLSAEERQREEQLVSFDSHEEWNQMQSQEDEVAITEQDLELIKERETAIRQLEADILDVNQIFKDLAMMIHDQGDLIDSIEANVESSEVHVERATEQLQRAAYYQKKSRKKMCILVLVLSVIILILGLIIWLVYKTK

SEQ ID NO: 179 - protein, 592 aa, Homo sapiens
MAPPVAERGLKSVVWQKIKATVFDDCKKEGEWKIMLLDEFTTKLLASCCKMTDLLEEGITVVENIYKNREPVRQMKALYFITPTSKSVDCFLHDFASKSENKYKAAYIYFTDFCPDNLFNKIKASCSKSIRRCKEINISFIPHESQVYTLDVPDAFYYCYSPDPGNAKGKDAIMETMADQIVTVCATLDENPGVRYKSKPLDNASKLAQLVEKKLEDYYKIDEKSLIKGKTHSQLLIIDRGFDPVSTVLHELTFQAMAYDLLPIENDTYKYKTDGKEKEAILEEEDDLWVRIRHRHIAVVLEEIPKLMKEISSTKKATEGKTSLSALTQLMKKMPHFRKQITKQVVHLNLAEDCMNKFKLNIEKLCKTEQDLALGTDAEGQKVKDSMRVLLPVLLNKNHDNCDKIRAILLYIFSINGTTEENLDRLIQNVKIENESDMIRNWSYLGVPIVPQSQQGKPLRKDRSAEETFQLSRWTPFIKDIMEDAIDNRLDSKEWPYCSQCPAVWNGSGAVSARQKPRANYLEDRKNGSKLIVFVIGGITYSEVRCAYEVSQAHKSCEVIIGSTHVLTPKKLLDDIKMLNKPKDKVSLIKDE

SEQ ID NO: 180 - protein, 454 aa, Homo sapiens
MSAGGPCPAAAGGGPGGASCSVGAPGGVSMFRWLEVLEKEFDKAFVDVDLLLGEIDPDQADITYEGRQKMTSLSSCFAQLCHKAQSVSQINHKLEAQLVDLKSELTETQAEKVVLEKEVHDQLLQLHSIQLQLHAKTGQSADSGTIKAKLERELEANKKEKMKEAQLEAEVKLLRKENEALRRHIAVLQAEVYGARLAAKYLDKELAGRVQQIQLLGRDMKGPAHDKLWNQLEAEIHLHRHKTVIRACRGRNDLKRPMQAPPGHDQDSLKKSQGVGPIRKVLLLKEDHEGLGISITGGKEHGVPILISEIHPGQPADRCGGLHVGDAILAVNGVNLRDTKHKEAVTILSQQRGEIEFEVVYVAPEVDSDDENVEYEDESGHRYRLYLDELEGGGNPGASCKDTSGEIKVLQGFNKKAVTDTHENGDLGTASETPLDDGASKLDDLHTLYHKKSY

SEQ ID NO: 181 - protein, 195 aa, Homo sapiens
MDPLFQQTHKQVHEIQSCMGRLETADKQSVHIVENEIQASIDQIFSRLERLEILSSKEPPNKRQNARLRVDQLKYDVQHLQTALRNFQHRRHAREQQERQREELLSRTFTTNDSDTTIPMDESLQFNSSLQKVHNGMDDLILDGHNILDGLRTQRLTLKVGSLLGDREKASCFSLIQQFSNCVYILITCPQIVIF

SEQ ID NO: 182 - protein, 325 aa, Homo sapiens
MATRRLTDAFLLLRNNSIQNRQLLAEQVSSHITSSPLHSRSIAAELDELADDRMALVSGISLDPEAAIGVTKRPPPKWVDGVDEIQYDVGRIKQKMKELASLHDKHLNRPTLDDSSEEEHAIEITTQEITQLFHRCQRAVQALPSRARACSEQEGRLLGNVVASLAQALQELSTSFRHAQSGYLKRMKNREERSQHFFDTSVPLMDDGDDNTLYHRGFTEDQLVLVEQNTLMVEEREREIRQIVQSISDLNEIFRDLGAMIVEQGTVLDRIDYNVEQSCIKTEDGLKQLHKAEQYQKKNRKMLVILILFVIIIVLIVVLVGVKSR

SEQ ID NO: 183 - protein, 118 aa, Homo sapiens
MSAPAQPPAEGTEGTAPGGGPPGPPPNMTSNRRLQQTQAQVEEVVDIIRVNVDKVLERDQKLSELDDRADALQAGASQFESSAAKLKRKYWWKNCKMMIMLGAICAIIVVVIVIYFFT

SEQ ID NO: 184 - protein, 335 aa, Homo sapiens
MAVDITLLFRASVKTVKTRNKALGVAVGGGVDGSRDELFRRSPRPKGDFSSRAREVISHIGKLRDFLLEHRKDYINAYSHTMSEYGRMTDTERDQIDQDAQIFMRTCSEAIQQLRTEAHKEIHSQQVKEHRTAVLDFIEDYLKRVCKLYSEQRAIRVKRVVDKKRLSKLEPEPNTKTRESTSSEKVSQSPSKDSEENPATEERPEKILAETQPELGTWGDGKGEDELSPEEIQMFEQENQRLIGEMNSLFDEVRQIEGRVVEISRLQEIFTEKVLQQEAEIDSIHQLVVGATENIKEGNEDIREAIKNNAGFRVWILFFLVMCSFSLLFLDWYDS

SEQ ID NO: 185 - protein, 287 aa, Homo sapiens
MRDRLPDLTACRKNDDGDTVVVVEKDHFMDDFFHQVEEIRNSIDKITQYVEEVKKNHSIILSAPNPEGKIKEELEDLNKEIKKTANKIRAKLKAIEQSFDQDESGNRTSVDLRIRRTQHSVLSRKFVEAMAEYNEAQTLFRERSKGRIQRQLEITGRTTTDDELEEMLESGKPSIFTSDIISDSQITRQALNEIESRHKDIMKLETSIRELHEMFMDMAMFVETQGEMINNIERNVMNATDYVEHAKEETKKAIKYQSKARRKLMFIIICVIVLLVILGIILATTLS

SEQ ID NO: 186 - protein, 289 aa, Homo sapiens
MKDRLEQLKAKQLTQDDDTDAVEIAIDNTAFMDEFFSEIEETRLNIDKISEHVEEAKKLYSIILSAPIPEPKTKDDLEQLTTEIKKRANNVRNKLKSMEKHIEEDEVRSSADLRIRKSQHSVLSRKFVEVMTKYNEAQVDFRERSKGRIQRQLEITGKKTTDEELEEMLESGNPAIFTSGIIDSQISKQALSEIEGRHKDIVRLESSIKELHDMFMDIAMLVENQGEMLDNIELNVMHTVDHVEKARDETKKAVKYQSQARKKLIIIIVLVVVLLGILALIIGLSVGLN

SEQ ID NO: 187 - protein, 1115 aa, Homo sapiens
MRKFNIRKVLDGLTAGSSSASQQQQQQHPPGNREPEIQETLQSEHFQLCKTVRHGFPYQPSALAFDPVQKILAVGTQTGALRLFGRPGVECYCQHDSGAAVIQLQFLINEGALVSALADDTLHLWNLRQKRPAILHSLKFCRERVTFCHLPFQSKWLYVGTERGNIHIVNVESFTLSGYVIMWNKAIELSSKSHPGPVVHISDNPMDEGKLLIGFESGTVVLWDLKSKKADYRYTYDEAIHSVAWHHEGKQFICSHSDGTLTIWNVRSPAKPVQTITPHGKQLKDGKKPEPCKPILKVEFKTTRSGEPFIILSGGLSYDTVGRRPCLTVMHGKSTAVLEMDYSIVDFLTLCETPYPNDFQEPYAVVVLLEKDLVLIDLAQNGYPIFENPYPLSIHESPVTCCEYFADCPVDLIPALYSVGARQKRQGYSKKEWPISGGNWGLGAQSYPEIIITGHADGSVKFWDASAITLQVLYKLKTSKVFEKSRNKDDRPNTDIVDEDPYAIQIISWCPESRMLCIAGVSAHVIIYRFSKQEVITEVIPMLEVRLLYEINDVETPEGEQPPPLPTPVGGSNPQPIPPQSHPSTSSSSSDGLRDNVPCLKVKNSPLKQSPGYQTELVIQLVWVGGEPPQQITSLAVNSSYGLVVFGNCNGIAMVDYLQKAVLLNLGTIELYGSNDPYRREPRSPRKSRQPSGAGLCDISEGTVVPEDRCKSPTSAKMSRKLSLPTDLKPDLDVKDNSFSRSRSSSVTSIDKESREAISALHFCETFTRKTDSSPSPCLWVGTTLGTVLVIALNLPPGGEQRLLQPVIVSPSGTILRLKGAILRMAFLDTTGCLIPPAYEPWREHNVPEEKDEKEKLKKRRPVSVSPSSSQEISENQYAVICSEKQAKVISLPTQNCAYKQNITETSFVLRGDIVALSNSICLACFCANGHIMTFSLPSLRPLLDVYYLPLTNMRIARTFCFTNNGQALYLVSPTEIQRLTYSQETCENLQEMLGELFTPVETPEAPNRGFFKGLFGGGAQSLDREELFGESSSGKASRSLAQHIPGPGGIEGVKGAASGVVGELARARLALDERGQKLGDLEERTAAMLSSAESFSKHAHEIMLKYKDKKWYQF

SEQ ID NO: 188 - protein, 158 aa, Homo sapiens
MDNLSSEEIQQRAHQITDESLESTRRILGLAIESQDAGIKTITMLDEQKEQLNRIEEGLDQINKDMRETEKTLTELNKCCGLCVCPCNSITNDAREDEMEENLTQVGSILGNLKDMALNIGNEIDAQNPQIKRITDKADTNRDRIDIANARAKKLIDS

SEQ ID NO: 189 - protein, 249 aa, Homo sapiens
MSLEDPFFVVRGEVQKAVNTARGLYQRWCELLQESAAVGREELDWTTNELRNGLRSIEWDLEDLEETIGIVEANPGKFKLPAGDLQERKVFVERMREAVQEMKDHMVSPTAVAFLERNNREILAGKPAAQKSPSDLLDASAVSATSRYIEEQQATQQLIMDEQDQQLEMVSGSIQVLKHMSGRVGEELDEQGIMLDAFAQEMDHTQSRMDGVLRKLAKVSHMTSDRRQWCAIAVLVGVLLLVLILLFSL

SEQ ID NO: 190 - protein, 355 aa, Homo sapiens
MIPRKRYGSKNTDQGVYLGLSKTQVLSPATAGSSSSDIAPLPPPVTLVPPPPDTMSCRDRTQEFLSACKSLQTRQNGIQTNKPALRAVRQRSEFTLMAKRIGKDLSNTFAKLEKLTILAKRKSLFDDKAVEIEELTYIIKQDINSLNKQIAQLQDFVRAKGSQSGRHLQTHSNTIVVSLQSKLASMSNDFKSVLEVRTENLKQQRSRREQFSRAPVSALPLAPNHLGGGAVVLGAESHASKDVAIDMMDSRTSQQLQLIDEQDSYIQSRADTMQNIESTIVELGSIFQQLAHMVKEQEETIQRIDENVLGAQLDVEAAHSEILKYFQSVTSNRWLMVKIFLILIVFFIIFVVFLA

SEQ ID NO: 191 - protein, 462 aa, Homo sapiens
MSAGGPCPAAAGGGPGGASCSVGAPGGVSMFRWLEVLEKEFDKAFVDVDLLLGEIDPDQADITYEGRQKMTSLSSCFAQLCHKAQSVSQINHKLEAQLVDLKSELTETQAEKVVLEKEVHDQLLQLHSIQLQLHAKTGQSADSGTIKAKLSGPSVEELERELEANKKEKMKEAQLEAEVKLLRKENEALRRHIAVLQAEVYGARLAAKYLDKELAGRVQQIQLLGRDMKGPAHDKLWNQLEAEIHLHRHKTVIRACRGRNDLKRPMQAPPGHDQDSLKKSQGVGPIRKVLLLKEDHEGLGISITGGKEHGVPILISEIHPGQPADRCGGLHVGDAILAVNGVNLRDTKHKEAVTILSQQRGEIEFEVVYVAPEVDSDDENVEYEDESGHRYRLYLDELEGGGNPGASCKDTSGEIKVLQGFNKKAVTDTHENGDLGTASETPLDDGASKLDDLHTLYHKKSY

SEQ ID NO: 192 - protein, 212 aa, Homo sapiens
MDPLFQQTHKQVHEIQSCMGRLETADKQSVHIVENEIQASIDQIFSRLERLEILSSKEPPNKRQNARLRVDQLKYDVQHLQTALRNFQHRRHAREQQERQREELLSRTFTTNDSDTTIPMDESLQFNSSLQKVHNGMDDLILDGHNILDGLRTQRLTLKGTQKKILDIANMLGLSNTVMRLIEKRAFQDKYFMIGGMLLTCVVMFLVVQYLT

SEQ ID NO: 193 - protein, 213 aa, Homo sapiens
MDPLFQQTHKQVHEIQSCMGRLETADKQSVHIVENEIQASIDQIFSRLERLEILSSKEPPNKRQNARLRVDQLKYDVQHLQTALRNFQHRRHAREQQERQREELLSRTFTTNDSDTTIPMDESLQFNSSLQKVHNGMDDLILDGHNILDGLRTQRLTLKGTQKKILDIANMLGLSNTVMRLIEKRAFQDKYFMIGTQGSCQTAHFGGRSAGSS

SEQ ID NO: 194 - protein, 255 aa, Homo sapiens
MSMEDPFFVVKGEVQKAVNTAQGLFQRWTELLQDPSTATREEIDWTTNELRNNLRSIEWDLEDLDETISIVEANPRKFNLDATELSIRKAFITSTRQVVRDMKDQMSTSSVQALAERKNRQALLGDSGSQNWSTGTTDKYGRLDRELQRANSHFIEEQQAQQQLIVEQQDEQLELVSGSIGVLKNMSQRIGGELEEQAVMLEDFSHELESTQSRLDNVMKKLAKVSHMTSDRRQWCAIAILFAVLLVVLILFLVL

SEQ ID NO: 195 - protein, 250 aa, Homo sapiens
MAAGTSSYWEDLRKQARQLENELDLKLVSFSKLCTSYSHSSTRDGRRDRYSSDTTPLLNGSSQDRMFETMAIEIEQLLARLTGVNDKMAEYTNSAGVPSLNAALMHTLQRHRDILQDYTHEFHKTKANFMAIRERENLMGSVRKDIESYKSGSGVNNRRTELFLKEHDHLRNSDRLIEETISIAMATKENMTSQRGMLKSIHSKMNTLANRFPAVNSLIQRINLRKRRDSLILGGVIGICTILLLLYAFH

SEQ ID NO: 196 - protein, 294 aa, Homo sapiens
MKDRLQELKQRTKEIELSRDSHVSTTETEEQGVFLQQAVIYEREPVAERHLHEIQKLQESINNLADNVQKFGQQQKSLVASMRRFSLLKRESTITKEIKIQAEYINRSLNDLVKEVKKSEVENGPSSVVTRILKSQHAAMFRHFQQIMFIYNDTIAAKQEKCKTFILRQLEVAGKEMSEEDVNDMLHQGKWEVFNESLLTEINITKAQLSEIEQRHKELVNLENQIKDLRDLFIQISLLVEEQGESINNIEMTVNSTKEYVNNTKEKFGLAVKYKKRNPCRVLCCWCCPCCSSK

SEQ ID NO: 197 - protein, 304 aa, Homo sapiens
MATRRLTDAFLLLRNNSIQNRQLLAEQLADDRMALVSGISLDPEAAIGVTKRPPPKWVDGVDEIQYDVGRIKQKMKELASLHDKHLNRPTLDDSSEEEHAIEITTQEITQLFHRCQRAVQALPSRARACSEQEGRLLGNVVASLAQALQELSTSFRHAQSGYLKRMKNREERSQHFFDTSVPLMDDGDDNTLYHRGFTEDQLVLVEQNTLMVEEREREIRQIVQSISDLNEIFRDLGAMIVEQGTVLDRIDYNVEQSCIKTEDGLKQLHKAEQYQKKNRKMLVILILFVIIIVLIVVLVGVKSR

SEQ ID NO: 198 - protein, 100 aa, Homo sapiens
MSTGPTAATGSNRRLQQTQNQVDEVVDIMRVNVDKVLERDQKLSELDDRADALQAGASQFETSAAKLKRKYWWKNCKMWAIGITVLVIFIIIIIVWVVSS

SEQ ID NO: 199 - protein, 117 aa, Homo sapiens
MSAPAQPPAEGTEGTAPGGGPPGPPPNMTSNRRLQQTQAQVEEVVDIIRVNVDKVLERDQKLSELDDRADALQAGASQFESSAAKLKRKYWWKNCKMMIMLGAICAIIVVVIVSKYR

SEQ ID NO: 200 - protein, 116 aa, Pongo pygmaeus
MSAPAQPPAEGTEGTAPGGGPPGPPPNMTSNRRLQQTQAQVEEVVDIIRVNVDKVLERDQKLSELDDRADALQAGASQFESSAAKLKRKYWWKNCKMMIMLGAICAIIVVVIVRRD

SEQ ID NO: 201 - protein, 494 aa, Homo sapiens
MAMSLPGSRRTSAGSRRRTSPPVSVRDAYGTSSLSSSSNSGSYKGSDSSPTPRRSMKYTLCSDNHGIKPPTPEQYLTPLQQKEVCIRHLKARLKDTQDRLQDRDTEIDDLKTQLSRMQEDWIEEECHRVEAQLALKEARKEIKQLKQVIDTVKNNLIDKDKGLQKYFVDINIQNKKLETLLHSMEVAQNGMAKEDGTGESAGGSPARSLTRSSTYTKLSDPAVCGDRQPGDPSSGSAEDGADSGFAAADDTLSRTDALEASSLLSSGVDCGTEETSLHSSFGLGPRFPASNTYEKLLCGMEAGVQASCMQERAIQTDFVQYQPDLDTILEKVTQAQVCGTDPESGDRCPELDAHPSGPRDPNSAVVVTVGDELEAPEPITRGPTPQRPGANPNPGQSVSVVCPMEEEEEAAVAEKEPKSYWSRHYIVDLLAVVVPAVPTVAWLCRSQRRQGQPIYNISSLLRGCCTVALHSIRRISCRSLSQPSPSPAGGGSQL

SEQ ID NO: 202 - protein, 198 aa, Homo sapiens
MKLYSLSVLYKGEAKVVLLKAAYDVSSFSFFQRSSVQEFMTFTSQLIVERSSKGTRASVKEQDYLCHVYVRNDSLAGVVIADNEYPSRVAFTLLEKVLDEFSKQVDRIDWPVGSPATIHYPALDGHLSRYQNPREADPMTKVQAELDETKIILHNTMESLLERGEKLDDLVSKSEVLGTQSKAFYKTARKQNSCCAIM

SEQ ID NO: 203 - protein, 297 aa, Homo sapiens
MRDRTHELRQGDDSSDEEDKERVALVVHPGTARLGSPDEEFFHKVRTIRQTIVKLGNKVQELEKQQVTILATPLPEESMKQELQNLRDEIKQLGREIRLQLKAIEPQKEEADENYNSVNTRMRKTQHGVLSQQFVELINKCNSMQSEYREKNVERIRRQLKITNAGMVSDEELEQMLDSGQSEVFVSNILKDTQVTRQALNEISARHSEIQQLERSIRELHDIFTFLATEVEMQGEMINRIEKNILSSADYVERGQEHVKTALENQKKARKKKVLIAICVSITVVLLAVIIGVTVVG

SEQ ID NO: 204 - protein, 287 aa, Homo sapiens
MKDRLAELLDLSKQYDQQFPDGDDEFDSPHEDIVFETDHILESLYRDIRDIQDENQLLVADVKRLGKQNARFLTSMRRLSSIKRDTNSIAKAIKARGEVIHCKLRAMKELSEAAEAQHGPHSAVARISRAQYNALTLTFQRAMHDYNQAEMKQRDNCKIRIQRQLEIMGKEVSGDQIEDMFEQGKWDVFSENLLADVKGARAALNEIESRHRELLRLESRIRDVHELFLQMAVLVEKQADTLNVIELNVQKTVDYTGQAKAQVRKAVQYEEKNPCRTLCCFCCPCLK

SEQ ID NO: 205 - protein, 513 aa, Homo sapiens
MSYGSIARGGGLGSRGPLGGPSRQGCQPLECARCWTEYGIRHFPCPSPESKLQNPCVGKDGEGDLGPAGTPIVPRARKRGPGVAPEGSRMPEPTSSPTIGPRKDSAAGPHGRMAGPSATRAKKRKPNFCPQETEVLVSKVSKHHQLLFGTGLLKAEPTRRYRVWSRILQAVNALGYCRRDVVDLKHKWRDLRAVVRRKLGDLRKAAHGPSPGSGKPQALALTPVEQVVAKTFSCQALPSEGFSLEPPRATQVDPCNLQELFQEMSANVFRINSSVTSLERSLQSLGTPSDTQELRDSLHTAQQETNKTIAASASSVKQMAELLRSSCPQERLQQERPQLDRLKTQLSDAIQCYGVVQKKIAEKSRALLPMAQRGSKQSPQAPFAELADDEKVFNGSDNMWQGQEQALLPDITEEDLEAIRLREEAILQMESNLLDVNQIIKDLASMVSEQGEAVDSIEASLEAASSHAEAARQLLAGASRHQLQRHKIKCCFLSAGVTALLVIIIIIATSVRK

SEQ ID NO: 206 - protein, 211 aa, Homo sapiens
MDNLSSEEIQQRAHQITDESLESTRRILGLAIESQDAGIKTITMLDEQKEQLNRIEEGLDQINKDMRETEKTLTELNKCCGLCVCPCNRTKNFESGKAYKTTWGDGGENSPCNVVSKQPGPVTNGQLQQPTTGAASGGYIKRITNDAREDEMEENLTQVGSILGNLKDMALNIGNEIDAQNPQIKRITDKADTNRDRIDIANARAKKLIDS

SEQ ID NO: 207 - protein, 590 aa, Homo sapiens
MSGDYEDDLCRRALILVSDLCARVRDADTNDRCQEFNDRIRGYPRGPDADISVSLLSVIVTFCGIVLLGVSLFVSWKLCWVPWRDKGGSAVGGGPLRKDLGPGVGLAGLVGGGGHHLAAGLGGHPLLGGPHHHAHAAHHPPFAELLEPGSLGGSDTPEPSYLDMDSYPEAAAAAVAAGVKPSQTSPELPSEGGAGSGLLLLPPSGGGLPSAQSHQQVTSLAPTTRYPALPRPLTQQTLTSQPDPSSEERPPALPLPLPGGEEKAKLIGQIKPELYQGTGPGGRRSGGGPGSGEAGTGAPCGRISFALRYLYGSDQLVVRILQALDLPAKDSNGFSDPYVKIYLLPDRKKKFQTKVHRKTLNPVFNETFQFSVPLAELAQRKLHFSVYDFDRFSRHDLIGQVVLDNLLELAEQPPDRPLWRDIVEGGSEKADLGELNFSLCYLPTAGRLTVTIIKASNLKAMDLTGFSDPYVKASLISEGRRLKKRKTSIKKNTLNPTYNEALVFDVAPESVENVGLSIAVVDYDCIGHNEVIGVCRVGPDAADPHGREHWAEMLANPRKPVEHWHQLVEEKTVTSFTKGSKGLSEKENSE

SEQ ID NO: 208 - protein, 232 aa, Homo sapiens
MASSAASSEHFEKLHEIFRGLHEDLQGVPERLLGTAGTEEKKKLIRDFDEKQQEANETLAEMEEELRYAPLSFRNPMMSKLRNYRKDLAKLHREVRSTPLTATPGGRGDMKYGIYAVENEHMNRLQSQRAMLLQGTESLNRATQSIERSHRIATETDQIGSEIIEELGEQRDQLERTKSRLVNTSENLSKSRKILRSMSRKVTTNKLLLSIIILLELAILGGLVYYKFFRSH

SEQ ID NO: 209 - protein, 236 aa, Homo sapiens
MAPDPWFSTYDSTCQIAQEIAEKIQQRNQYERKGEKAPKLTVTIRALLQNLKEKIALLKDLLLRAVSTHQITQLEGDRRQNLLDDLVTRERLLLASFKNEGAEPDLIRSSLMSEEAKRGAPNPWLFEEPEETRGLGFDEIRQQQQKIIQEQDAGLDALSSIISRQKQMGQEIGNELDEQNEIIDDLANLVENTDEKLRNETRRVNMVDRKSASCGMIMVILLLLVAIVVVAVWPTN

SEQ ID NO: 210 - protein, 288 aa, Rattus norvegicus; identical to SEQ ID NO: 175

SEQ ID NO: 211 - protein, 259 aa, Homo sapiens; identical to SEQ ID NO: 177

SEQ ID NO: 212 - protein, 288 aa, Homo sapiens; identical to SEQ ID NO: 175

SEQ ID NO: 213 - protein, 203 aa, Homo sapiens
MSSDFEGYEQDFAVLTAEITSKIARVPRLPPDEKKQMVANVEKQLEEAKELLEQMDLEVREIPPQSRGMYSNRMRSYKQEMGKLETDFKRSRIAYSDEVRNELLGDDGNSSENQRAHLLDNTERLERSSRRLEAGYQIAVETEQIGQEMLENLSHDREKIQRARERLRETDANLGKSSRILTGMLRRGCSVKKQCNLSLAPKA

SEQ ID NO: 214 - protein, 302 aa, Homo sapiens [sequence omitted]

SEQ ID NO: 215 - protein, 287 aa, Homo sapiens; identical to SEQ ID NO: 185

SEQ ID NO: 216 - protein, 297 aa, Homo sapiens; identical to SEQ ID NO: 203

SEQ ID NO: 217 - protein, 134 aa, Homo sapiens
MEFVMKQALGGATKDMGKMLGGDEEKDPDAAKKEEERQEALRQAEEERKAKYAKMEAEREAVRQGIRDKYGIKKKEEREAEAQAAMEANSEGSLTRPKKAIPPGCGDEVEEEDESILDTVIKYLPGPLQDMLKK

SEQ ID NO: 218 - protein, 289 aa, Homo sapiens; identical to SEQ ID NO: 186

SEQ ID NO: 219 - protein, 276 aa, Homo sapiens; identical to SEQ ID NO: 178

SEQ ID NO: 220 - protein, 250 aa, Homo sapiens; identical to SEQ ID NO: 195

SEQ ID NO: 221 - protein, 287 aa, Homo sapiens; identical to SEQ ID NO: 204

SEQ ID NO: 222 - protein, 294 aa, Homo sapiens; identical to SEQ ID NO: 196

SEQ ID NO: 223 - protein, 211 aa, Homo sapiens; identical to SEQ ID NO: 206

SEQ ID NO: 224 - protein, 258 aa, Homo sapiens; identical to SEQ ID NO: 169

SEQ ID NO: 225 - protein, 236 aa, Homo sapiens; identical to SEQ ID NO: 209

SEQ ID NO: 226 - protein, 261 aa, Homo sapiens; identical to SEQ ID NO: 161

SEQ ID NO: 227 - protein, 206 aa, Homo sapiens; identical to SEQ ID NO: 172

SEQ ID NO: 228 - protein, 513 aa, Homo sapiens
MSYGSIARGGGLGSRGPFGGPSRQGCQPLECARCWTEYGIRHFPCPSPESKLQNRCVGKDGEGDLGPAGTPIVPRARKRGPGVAPEGSRMPEPTSSPTIGPRKDSAAGPHGRMAGPSTTRAKKRKPNFCPQETEVLVSKVSKHHQLLFGTGLLKAEPTRRYRVWSRILQAVNALGYCRRDVVDLKHKWRDLRAVVRRKLGDLRKAAHGPSPGSGKPQALALTPVEQVVAKTFSCQALPSEGFSLEPPRATQVDPCNLQELFQEMSANVFRINSSVTSLERSLQSLGTPSDTQELRDSLHTAQQETNKTIAASASSVKQMAELLRSSCPQERLQQERPQLDRLKTQLSDAIQCYGVVQKKIAEKSRALLPMAQRGSKQSPQAPFAELADDEKVFNGSDNMWQGQEQALLPDITEEDLEAIRLREEAILQMESNLLDVNQIIKDLASMVSEQGEAVDSIEASLEAASSHAEAARQLLAGASRHQLQRHKIKCCFLSAGVTALLVIIIIIATSVRK

SEQ ID NO: 229 - protein, 288 aa, Homo sapiens; identical to SEQ ID NO: 163

SEQ ID NO: 230 - protein, 355 aa, Homo sapiens; identical to SEQ ID NO: 190

SEQ ID NO: 231 - protein, 258 aa, Homo sapiens; identical to SEQ ID NO: 169

SEQ ID NO: 232 - protein, 200 aa, Homo sapiens
MSLEDPFFVVRGEVQKAVNTARGLYQRWCELLQESAAVGREELDWTTNELRNGLRSIEWDLEDLEETIGIVEANPGKPAAQKSPSDLLDASAVSATSRYIEEQQATQQLIMDEQDQQLEMVSGSIQVLKHMSGRVGEELDEQGIMLDAFAQEMDHTQSRMDGVLRKLAKVSHMTSDRRQWCAIAVLVGVLLLVLILLFSL

SEQ ID NO: 233 - protein, 294 aa, Homo sapiens; identical to SEQ ID NO: 196

SEQ ID NO: 234 - protein, 198 aa, Homo sapiens
MKLYSLSVLYKGEAKVVLLKAAYDVSSFSFFQRSSVQEFMTFTSQLIVERSSKGTRASVKEQDYLCHVYVRNDSLAGVVIADNEYPSRVAFTLLEKVLDEFSKQVDRIDWPVGSPATIHYPALDGHLSRYQNPREADLMTKVQAELDETKIILHNTMESLLERGEKLDDLVSKSEVLGTQSKAFYKTARKQNSCCAIM

SEQ ID NO: 235 - protein, 279 aa, Homo sapiens [sequence omitted]

SEQ ID NO: 236 - protein, 297 aa, Homo sapiens; identical to SEQ ID NO: 203

SEQ ID NO: 237 - protein, 255 aa, Homo sapiens; identical to SEQ ID NO: 194

SEQ ID NO: 238 - protein, 289 aa, Homo sapiens; identical to SEQ ID NO: 186

SEQ ID NO: 239 - protein, 246 aa, Homo sapiens
MSLEDPFFVVRGEVQKAVNTARGLYQRWCELLQESAAVGREELDWTTNELRNGLRSIEWDLEDLEETIGIVEANPGKFKLPAGDLQERKVFVERMREAVQEMKDHMVSPTAVAFLERNNREILAGKPAAQKSPSDLLDASAVSATSRYIEEQQATQQLIMDEQDQQLEMVSGSIQVLKHMSGRVGEELDEQGIMLDAFAQEMDHTQSRMDGVLRKLAKVSHMTSGESPQGRGQSWWGQVVGGTLSP

SEQ ID NO: 240 - protein, 260 aa, Homo sapiens
MKDRTQELRTAKDSDDDDDVAVTVDRDRFMDEFFEQVEEIRGFIDKIAENVEEVKRKHSAILASPNPDEKTKEELEELMSDIKKTANKVRSKLKSIEQSIEQEEGLNRSSADLRIRKTQHSTLSRKFVEVMSEYNATQSDYRERCKGRIQRQLEITGRTTTSEELEDMLESGNPAIFASGIIMDSSISKQALSEIETRHSEIIKLENSIRELHDMFMDMAMLVESQPQGAFLKSCPEPQPNPEEGALWSSGAPGPAGRDD

SEQ ID NO: 241 - protein, 236 aa, Homo sapiens; identical to SEQ ID NO: 209

SEQ ID NO: 242 - protein, 198 aa, Homo sapiens; identical to SEQ ID NO: 202

SEQ ID NO: 243 - protein, 136 aa, Homo sapiens; identical to SEQ ID NO: 165

SEQ ID NO: 244 - protein, 211 aa, Homo sapiens; identical to SEQ ID NO: 206

SEQ ID NO: 245 - protein, 158 aa, Homo sapiens; identical to SEQ ID NO: 188

SEQ ID NO: 246 - protein, 100 aa, Homo sapiens; identical to SEQ ID NO: 198

SEQ ID NO: 247 - protein, 202 aa, Homo sapiens
MATRRLTDAFLLLRNNSIQNRQLLAEQELDELADDRMALVSGISLDPEAAIGVTKRPPPKWVDGVDEIQYDVGRIKQKMKELASLHDKHLNRPTLDDSSEEEHAIEITTQEITQLFHRCQRAVQALPSRARACSEQEGRLLGNVVASLAQALQELSTSFRHAQSGYLKRMKNREERSQHFFDTSVPLMDDGDDNTLYHRRTS

SEQ ID NO: 248 - protein, 260 aa, Homo sapiens
MAILFAVVARGTTILAKHAWCGGNFLEVTEQILAKIPSENNKLTYSHGNYLFHYICQDRIVYLCITDDDFERSRAFNFLNEIKKRFQTTYGSRAQTALPYAMNSEFSSVLAAQLKHHSENKGLDKVMETQAQVDELKGIMVRNIVCHLQNYQQKSCSSHVYEEPQAHYYHHHRINCVHLYHCFTSLWWIYMAKLCEEIGKKKLPLTKDMREQGVKSNPCDSSLSHTDRWYLPVSSTLFSLFKILFHASRFIFVLSTSLFL

SEQ ID NO: 249 - protein, 335 aa, Homo sapiens; identical to SEQ ID NO: 184

SEQ ID NO: 250 - protein, 538 aa, Homo sapiens
MPGSGPSERMTWPGPALSAGPPTRPLSSAPGIPPIPPLTRTHSLMAMSLPGSRRTSAGSRRRTSPPVSVRDAYGTSSLSSSSNSGSYKGSDSSPTPRRSMKYTLCSDNHGIKPPTPEQYLTPLQQKEVCIRHLKARLKDTQDRLQDRDTEIDDLKTQLSRMQEDWIEEECHRVEAQLALKEARKEIKQLKQVIDTVKNNLIDKDKGLQKYFVDINIQNKKLETLLHSMEVAQNGMAKEDGTGESAGGSPARSLTRSSTYTKLSDPAVCGDRQPGDPSSGSAEDGADSGFAAADDTLSRTDALEASSLLSSGVDCGTEETSLHSSFGLGPRFPASNTYEKLLCGMEAGVQASCMQERAIQTDFVQYQPDLDTILEKVTQAQVCGTDPESGDRCPELDAHPSGPRDPNSAVVVTVGDELEAPEPITRGPTPQRPGANPNPGQSVSVVCPMEEEEEAAVAEKEPKSYWSRHYIVDLLAVVVPAVPTVAWLCRSQRRQGQPIYNISSLLRGCCTVALHSIRRISCRSLSQPSPSPAGGGSQL

SEQ ID NO: 251 - protein, 136 aa, Homo sapiens; identical to SEQ ID NO: 165

SEQ ID NO: 252 - protein, 592 aa, Homo sapiens; identical to SEQ ID NO: 179

SEQ ID NO: 253 - protein, 250 aa, Homo sapiens; identical to SEQ ID NO: 195

SEQ ID NO: 254 - protein, 287 aa, Homo sapiens [sequence omitted]

SEQ ID NO: 255 - protein, 301 aa, Homo sapiens
MSCRDRTQEFLSACKSLQTRQNGIQTNKPALRAVRQRSEFTLMAKRIGKDLSNTFAKLEKLTILAKRKSLFDDKAVEIEELTYIIKQDINSLNKQIAQLQDFVRAKGSQSGRHLQTHSNTIVVSLQSKLASMSNDFKSVLEVRTENLKQQRSRREQFSRAPVSALPLAPNHLGGGAVVLGAESHASKDVAIDMMDSRTSQQLQLIDEQDSYIQSRADTMQNIESTIVELGSIFQQLAHMVKEQEETIQRIDENVLGAQLDVEAAHSEILKYFQSVTSNRWLMVKIFLILIVFFIIFVVFLA

SEQ ID NO: 256 - protein, 261 aa, Homo sapiens
MSYTPGVGGDPTQLAQRISSNIQKITQCSVEIQRTLNQLGTPQDSPELRQQLQQKQQYTNQLAKETDKYIKEFGSLPTTPSEQRQRKIQKDRLVAEFTTSLTNFQKVQRQAAEREKEFVARVRASSRVSGSFPEDSSKERNLVSWESQTQPQVQVQDEEITEDDLRLIHERESSIRQLEADIMDINEIFKDLGMMIHEQGDVIDSIEANVENAEVHVQQANQQLSRAADYQRKSRKTLCIIILILVIGVAIISLIIWGLNH

SEQ ID NO: 257 - protein, 141 aa, Homo sapiens
MPPKFKRHLNDDDVTGSVKSERRNLLEDDSDEEEDFFLRGPSGPRFGPRNDKIKHVQNQVDEVIDVMPENITKVIERGERLDELQDKSESLSDNATAFSNRSKQLRRQMWWRGCKIKAIMALVAAILLLVIIILIVMKYRT

SEQ ID NO: 258 - protein, 307 aa, Homo sapiens [sequence omitted]

SEQ ID NO: 259 - protein, 249 aa, Homo sapiens; identical to SEQ ID NO: 189

SEQ ID NO: 260 - protein, 297 aa, Homo sapiens; identical to SEQ ID NO: 203

SEQ ID NO: 261 - protein, 212 aa, Homo sapiens [sequence omitted]

SEQ ID NO: 262 - protein, 289 aa, Homo sapiens [sequence omitted]

SEQ ID NO: 263 - protein, 297 aa, Homo sapiens
MRDRTHELRQGDDSSDEEDKERVALVVHPGTARLGSPDEEFFHKVRTIRQTIVKLGNKVQELEKQQVTILATPLPEESMKQELQNLRDEIKQLGREIRLQLKAIEPQKEEADENYNSVNTRMRKTQHGVLSQQFVELINKCNSMQSEYREKNVERIRRQLKITNAGMVSDEELDQMLDSGQSEVFVSNILKDTQVTRQALNEISARHSEIQQLERSIRELHDIFTFLATEVEMQGEMINRIEKNILSSADYVERGQEHVKTALENQKKVRKKKVLIAICVSITVVLLAVIIGVTVVG

SEQ ID NO: 264 - DNA, 20 bp, Artificial
  Synthetic
acgtaagcaacgctcagcta

What is claimed:

1. A method of treating neuropathic pain in a patient in need thereof, comprising administering to said patient an effective amount of an antagonist for a nucleic acid sequence encoding synaptosome-associated proteins of 25 kDa (SNAP 25)-interacting proteins of 30 kDa (SIP30) or SIP30-related protein activity, wherein said antagonist comprises an isolated nucleic acid.

2. The method according to claim 1, wherein the nucleic acid is a complementary sequence to a portion of SIP30 or SIP30-related sequence.

3. The method according to claim 1, wherein the nucleic acid is of a length no shorter than 11 bases.

4. The method according to claim 1, wherein the nucleic acid contains at least one unmodified base.

5. The method according to claim 1, wherein the nucleic acid contains at least one modified base.

6. The method according to claim 1, wherein the nucleic acid is composed of a mixture of unmodified and modified bases.

7. The method according to claim 1, wherein the nucleic acid can be administered alone or in pharmaceutically suitable solutions for in vivo administration.

8. The method according to claim 7, further comprising the step of administering a second therapeutic agent.

9. The method according to claim 8, wherein the second therapeutic agent is an agent selected from the group consisting of anticonvulsants, anti-inflammatory agents, and anesthetics.

10. The method according to claim 1, wherein the antagonist further comprises a substance for enhancing nucleic acid in vivo stability selected from the group consisting of an enzyme inhibitor, stabilizing agents of nucleic acids, and a combination thereof.

11. The method according to claim 1, wherein the nucleic acid is in a pharmaceutical delivery form selected from the group consisting of depot form, injectable form, topical form, ingestible form, spray form, inhalant form, electroporatable form, and a combination thereof.

12. The method according to claim 11, wherein the antagonist is in a controlled release form.

13. The method according to claim 1, wherein the nucleic acid is administered to the subject by a method selected from the group consisting of electroporation, calcium phosphate co-precipitation, microinjection, lipofection, polyfection, and conjugation to cell penetrating peptides.

14. The method according to claim 1, wherein the nucleic acid is a siRNA having a specific substrate binding site complementary to SIP30.

15. The method according to claim 14, wherein said siRNA is 11 to 31 nucleotides in length.

16. The method according to claim 15, wherein the siRNA comprises a first strand and a second strand, wherein the first strand is a sense strand having identity with a portion of SEQ. ID. NO: 130.

17. The method of claim 16 wherein said siRNA is introduced into the desired tissue by means of an injection, a pump or a depot.

18. The method according to claim 1, wherein the nucleic acids is selected from the group consisting of SEQ ID NO. 131 and SEQ ID NO. 132.

19. The method according to claim 17, wherein the siRNA is selected from the group consisting of SEQ ID NO. 131 and SEQ ID NO. 132.

20. The method according to claim 15, wherein said siRNA is encoded in a vector system.

21. The method according to claim 20, wherein said vector system is an adenoassociated viral vector system.

* * * * *

UNITED STATES PATENT AND TRADEMARK OFFICE
CERTIFICATE OF CORRECTION

PATENT NO. : 9,068,984 B2
APPLICATION NO. : 13/393399
DATED : June 30, 2015
INVENTOR(S) : Lei Yu et al.

Page 1 of 1

It is certified that error appears in the above-identified patent and that said Letters Patent is hereby corrected as shown below:

In the Specification

At Column 1, Line 17, delete:
"The Research leading to the present invention was supported in part, by NIH Grant No. R01 DA013471. Accordingly, the U.S. Government has certain rights in this invention."
And insert:
--This invention was made with government support under grant numbers DA013471 and DA020555 awarded by the National Institutes of Health. The government has certain rights in the invention.--

Signed and Sealed this
First Day of March, 2022

Drew Hirshfeld
*Performing the Functions and Duties of the
Under Secretary of Commerce for Intellectual Property and
Director of the United States Patent and Trademark Office*